(12) United States Patent
Barnes et al.

(10) Patent No.: US 7,547,766 B2
(45) Date of Patent: Jun. 16, 2009

(54) ANTI-TANGO294 ANTIBODIES AND USES THEREOF

(75) Inventors: Thomas M. Barnes, Brookline, MA (US); John D. Sharp, Arlington, MA (US)

(73) Assignee: Millennium Pharmaceuticals, Inc., Cambridge, MA (US)

(*) Notice: Subject to any disclaimer, the term of this patent is extended or adjusted under 35 U.S.C. 154(b) by 731 days.

(21) Appl. No.: 10/741,790

(22) Filed: Dec. 19, 2003

(65) Prior Publication Data

US 2004/0121396 A1    Jun. 24, 2004

Related U.S. Application Data

(63) Continuation-in-part of application No. 09/578,063, filed on May 24, 2000, now Pat. No. 6,764,677, and a continuation-in-part of application No. 09/559,497, filed on Apr. 27, 2000, now abandoned, and a continuation-in-part of application No. 09/479,249, filed on Jan. 7, 2000, now abandoned, which is a continuation-in-part of application No. 09/333,159, filed on Jun. 14, 1999, now Pat. No. 7,033,780, application No. 10/741,790, which is a continuation-in-part of application No. 09/596,194, filed on Jun. 16, 2000, now abandoned, which is a continuation-in-part of application No. 09/342,364, filed on Jun. 29, 1999, now abandoned, application No. 10/741,790, which is a continuation-in-part of application No. 09/608,452, filed on Jun. 30, 2000, now abandoned, which is a continuation-in-part of application No. 09/393,996, filed on Sep. 10, 1999, now abandoned, application No. 10/741,790, which is a continuation-in-part of application No. 09/602,871, filed on Jun. 23, 2000, now abandoned, which is a continuation-in-part of application No. 09/420,707, filed on Oct. 19, 1999, now abandoned.

(51) Int. Cl.
C07K 16/00    (2006.01)

(52) U.S. Cl. ............ 530/388.1; 530/387.3; 530/388.15; 530/391.3

(58) Field of Classification Search ........................ None
See application file for complete search history.

(56) References Cited

U.S. PATENT DOCUMENTS 3,654,090 A * 4/1972 Hermanus et al. .......... 435/7.93
5,807,726 A * 9/1998 Blanchard et al.

FOREIGN PATENT DOCUMENTS

| | | |
|---|---|---|
| EP | 0911399 | 4/1999 |
| JP | 95/14772 | 1/1995 |
| WO | WO 96/34873 | 11/1996 |
| WO | WO 98/45436 | 10/1998 |
| WO | WO 99/06550 | 2/1999 |
| WO | WO 00/06698 | 2/2000 |

OTHER PUBLICATIONS

Sequence search results: sequence alignment between SEQ ID No. 417 of the present application and SEQ ID No. 3 of US5,807,726.*
Sequence search results: sequence alignment between SEQ ID No. 417 of the present application and sequence in Figure 4 of Anderson et al. J. Biol. Chem., 1991, 266: 22479-84.*
Nakagawa et al. Cloning of rat lysosomal acid lipase cDNA and identification of the mutation in the rat model Wolman's disease. J. Lipid Res., 1995, 36:2212-2218.*
Campbell, A. Laboratory Techniques in Biochemistry And Molecular Biology, vol. 13, Chapter 1, pp. 1-33, 1984.*
Sandhu, J.S. Protein engineering of antibodies. 1992, Critical Reviews in Biotech., 12(5/6): 437-462.*
E. Benjamini et al., "Antigenicity". Immunology, A Short Course, 2nd ed., 1992 (John Wiley & Sons, Inc.), p. 40.*
S. Vukicevic et al. Induction of nephrogenic mesenchyme by osteogenic protein 1 (bone morphogenetic protein 7). 1996. Proc. Natl. Acad. Sci. USA, 93: 9021-26.*
J. Skolnick et al. From genes to protein structure and function: novel applications of computational approaches in the genomic era. 2000. Trends in Biotechnology, 18(1): 34-39.*
S. E. Brenner. Errors in genome annotation. 1999. Trends in Genetics, 15(4): 132-33.*
R.A. Anderson et al. Cloning and expression of cDNA encoding human lysosomal acid lipase/cholesteryl ester hydrolase. 1991. J. Biol. Chem., 266(33): 22479-84.*
H. Du et al. Locus HSU08464, Jun. 23, 1994. Accessed Aug. 27, 2001 (see attached computer printout).*
Elsbach, 1998, Journal of Leukocyte Biology, 64:14-18.

* cited by examiner

Primary Examiner—Dong Jiang

(57) ABSTRACT

The invention provides isolated nucleic acids encoding a variety of proteins having diagnostic, preventive, therapeutic, and other uses. These nucleic and proteins are useful for diagnosis, prevention, and therapy of a number of human and other animal disorders. The invention also provides antisense nucleic acid molecules, expression vectors containing the nucleic acid molecules of the invention, host cells into which the expression vectors have been introduced, and non-human transgenic animals in which a nucleic acid molecule of the invention has been introduced or disrupted. The invention still further provides isolated polypeptides, fusion polypeptides, antigenic peptides and antibodies. Diagnostic, screening, and therapeutic methods using compositions of the invention are also provided. The nucleic acids and polypeptides of the present invention are useful as modulating agents in regulating a variety of cellular processes.

7 Claims, 213 Drawing Sheets

```
   T416    1651 GAAAAGAGATCTGAGTATAGTTTGACTGTAATCGCTGAGGACAGGGGGAC 1700
                     |||||||||||||||||||||||||||||||||||||||||||||
AL137471    1 ....AAGAGATCTGAGTATAGTTTGACTGTAATCGCTGAGGACAGGGGGAC   47

T416    1701 ACCCAGTCTCTCTACAGTGAAACATTTACAGTTCAAATCAATGATATCA 1750
                |||||||||||||||||||||||||||||||||||||||||||||||||
AL137471   48 ACCCAGTCTCTCTACAGTGAAACATTTACAGTTCAAATCAATGATATCA   97

T416    1751 ATGACAATCCACCCCCACTTCCAGAGAAGCCGATATGAATTTGTAATTTCA 1800
                ||||||||||||| ||||||||||||||||||||||||||||||||||||
AL137471   98 ATGACAATCCACCCCCACTTCCAGAGAAGCCGATATGAATTTGTAATTTCA  147

T416    1801 GAAAATAAACTCACCAGGGCATATATCACCACTGTTACAGCCACAGATCC 1850
                ||||||||||||||||||||||||||||||||||||||||||||||||||
AL137471  148 GAAAATAAACTCACCAGGGCATATATCACCACTGTTACAGCCACAGATCC  197

T416    1851 TGATCTTGGAGAAAATGGGCAAGTGACATACACCATCTTGGAGAGTTTTA 1900
                ||||||||||||||||||||||||||||||||||||||||||||||||||
AL137471  198 TGATCTTGGAGAAAATGGGCAAGTGACATACACCATCTTGGAGAGTTTTA  247

T416    1901 TTCTAGGAAGTTCCATAACTACATATGTAACCATTGACCCATCTAATGGA 1950
                ||||||||||||||||||||||||||||||||||||||||||||||||||
AL137471  248 TTCTAGGAAGTTCCATAACTACATATGTAACCATTGACCCATCTAATGGA  297
```

FIG. 2A

```
T416      1951 GCCATCTATGCCCTCAGAATCTTTGATCATGAAGAAGTGAGTCAGATCAC 2000
               ||||||||||||||||||||||||||||||||||||||||||||||||||
AL137471   298 GCCATCTATGCCCTCAGAATCTTTGATCATGAAGAAGTGAGTCAGATCAC  347

T416      2001 TTTTGTGGTAGAAGCAAGAGAGATGGAGGAAGCCCGAAGCAACTGGTAAGCA 2050
               ||||||||||||||||||||||||||||||||||||||||||||||||||
AL137471   348 TTTTGTGGTAGAAGCAAGAGAGATGGAGGAAGCCCGAAGCAACTGGTAAGCA  397

T416      2051 ATACCACAGTTGTGCTCACCATCATTGACGAAAATGACAACGTTCCTGTG 2100
               ||||||||||||||||||||||||||||||||||||||||||||||||||
AL137471   398 ATACCACAGTTGTGCTCACCATCATTGACGAAAATGACAACGTTCCTGTG  447

T416      2101 GTTATAGGGCCTGCATTGCGTAATAATACGGCAGAAATCACCATTCCCAA 2150
               ||||||||||||||||||||||||||||||||||||||||||||||||||
AL137471   448 GTTATAGGGCCTGCATTGCGTAATAATACGGCAGAAATCACCATTCCCAA  497

T416      2151 AGGGGCTGAAAGTGGCTTTCATGTCACAAGAATAAGGGCAATTGACAGAG 2200
               ||||||||||||||||||||||||||||||||||||||||||||||||||
AL137471   498 AGGGGCTGAAAGTGGCTTTCATGTCACAAGAATAAGGGCAATTGACAGAG  547

T416      2201 ACTCTGGTGTGAATGCTCAGCTGCGCCATAGTAGCAGGTAATGAG 2250
               ||||||||||||||||||||||||||||||||||||||||||||||||||
AL137471   548 ACTCTGGTGTGAATGCTCAGCTGCGCCATAGTAGCAGGTAATGAG  597
```

FIG. 2B

```
T416      2251 GAGAATATCTTCATAATTGATCCACGATCATGTGACATCATGTGACATCCATACCAACGT 2300
                    ||||||||||||||||||||||||||||||||||||||||||||||||||||||||||||
AL137471   598 GAGAATATCTTCATAATTGATCCACGATCATGTGACATCCATACCAACGT  647

T416      2301 TAGCATGGATTCTGTTCCCTACACAGAATGGGAGCTGTCAGTTATCATTC 2350
                    ||||||||||||||||||||||||||||||||||||||||||||||||||
AL137471   648 TAGCATGGATTCTGTTCCCTACACAGAATGGGAGCTGTCAGTTATCATTC  697

T416      2351 AGGACAAAGGCAATCCTCAGCTACATACCAAAGTCCTTCTGAAGTGCATG 2400
                    ||||||||||||||||||||||||||||||||||||||||||||||||||
AL137471   698 AGGACAAAGGCAATCCTCAGCTACATACCAAAGTCCTTCTGAAGTGCATG  747

T416      2401 ATCTTTGAATATGCAGAGTCGGTGACAAGTACAGCAATGACTTCAGTAAG 2450
                    ||||||||||||||||||||||||||||||||||||||||||||||||||
AL137471   748 ATCTTTGAATATGCAGAGTCGGTGACAAGTACAGCAATGACTTCAGTAAG  797

T416      2451 CCAGGCATCCTTGGATGTCTCCATGATAATAATTATTTCCTTAGGAGCAA 2500
                    ||||||||||||||||||||||||||||||||||||||||||||||||||
AL137471   798 CCAGGCATCCTTGGATGTCTCCATGATAATAATTATTTCCTTAGGAGCAA  847

T416      2501 TTTGTGCAGTGTTGCTGGTTATTATGGTGCTATTTGCAACTAGGTGTAAC 2550
                    ||||||||||||||||||||||||||||||||||||||||||||||||||
AL137471   848 TTTGTGCAGTGTTGCTGGTTATTATGGTGCTATTTGCAACTAGGTGTAAC  897
```

FIG. 2C

```
T416       2551 CGCGAGAGAAAGACACTAGATCCTATAACTGCAGGGTGGCCGAATCAAC 2600
                ||||||||||||||||||||||||||||||||||||||||||||||||
AL137471    898 CGCGAGAGAAAGACACTAGATCCTATAACTGCAGGGTGGCCGAATCAAC  947

T416       2601 TTACCAGCACCACCCAAAAAGGCCATCCCGGCAGATTCACAAGGGGACA 2650
                ||||||||||||||||||||||||||||||||||||||||||||||||
AL137471    948 TTACCAGCACCACCCAAAAAGGCCATCCCGGCAGATTCACAAGGGGACA  997

T416       2651 TCACATTGGTGCCTACCATAAATGGCCACTCTGCCCATCAGATCTCATCAC 2700
                ||||||||||||||||||||||||||||||||||||||||||||||||
AL137471    998 TCACATTGGTGCCTACCATAAATGGCCACTCTGCCCATCAGATCTCATCAC 1047

T416       2701 AGATCGTCTCCATCTTTCATCTCCTACCTTTAGAAAAGAGGGCAGATGGGCAG 2750
                ||||||||||||||||||||||||||||||||||||||||||||||||
AL137471   1048 AGATCGTCTCCATCTTTCATCTCCTACCTTTAGAAAAGAGGGCAGATGGGCAG 1097

T416       2751 CCGGCAGAGTCACAACAGTCACCAGTCACTCAACAGTTTGGTGACAATCT 2800
                ||||||||||||||||||||||||||||||||||||||||||||||||
AL137471   1098 CCGGCAGAGTCACAACAGTCACCAGTCACTCAACAGTTTGGTGACAATCT 1147

T416       2801 CATCAAACCACGTGCCAGAGAATTTCTCATTAGAACTCACCCACGCCACT 2850
                ||||||||||||||||||||||||||||||||||||||||||||||||
AL137471   1148 CATCAAACCACGTGCCAGAGAATTTCTCATTAGAACTCACCCACGCCACT 1197
```

FIG. 2D

```
T416     2851 CCTGCTGTTGAGCAGGTCTCTCAGCTTCTTCAATGCTTCACCAGGGGCA 2900
              ||||||||||||||||||||||||||||||||||||||||||||||||
AL137471 1198 CCTGCTGTTGAGCAGGTCTCTCAGCTTCTTCAATGCTTCACCAGGGGCA 1247

T416     2901 ATATCAGCCAAGACCAAGTTTTCGAGGAAACAAATATTCCAGGAGCTACA 2950
              ||||||||||||||||||||||||||||||||||||||||||||||||
AL137471 1248 ATATCAGCCAAGACCAAGTTTTCGAGGAAACAAATATTCCAGGAGCTACA 1297

T416     2951 GATATGCCCTTCAAGACACATGGACAGTGATTAGCTTGAAAGACAGTGGCCGT 3000
              ||||||||||||||||||||||||||||||||||||||||||||||||
AL137471 1298 GATATGCCCTTCAAGACACATGGACAGTGATTAGCTTGAAAGACAGTGGCCGT 1347

T416     3001 GGTGACAGTGAGGCAGGAGACAGTGATTATGATTTGGGCGAGATTCTCC 3050
              ||||||||||||||||||||||||||||||||||||||||||||||||
AL137471 1348 GGTGACAGTGAGGCAGGAGACAGTGATTATGATTTGGGCGAGATTCTCC 1397

T416     3051 AATAGATAGGCTGCTGTTGGGTGAAGGATTCAGCGACCTGTTTCTCACAGATG 3100
              ||||||||||||||||||||||||||||||||||||||||||||||||
AL137471 1398 AATAGATAGGCTGCTGTTGGGTGAAGGATTCAGCGACCTGTTTCTCACAGATG 1447

T416     3101 GAAGAATTCCAGCAGCTATGAGACTCTGCACGGAGAGTGCAGGGTCCTG 3150
              ||||||||||||||||||||||||||||||||||||||||||||||||
AL137471 1448 GAAGAATTCCAGCAGCTATGAGACTCTGCACGGAGAGTGCAGGGTCCTG 1497
```

FIG. 2E

```
T416      3151 GGACACTCTGACCAGTGCTGGATGCCACCACTGCCCCTCACCGTCTTCTGA 3200
               ||||||||||||||||||||||||||||||||||||||||||||||||||
AL137471  1498 GGACACTCTGACCAGTGCTGGATGCCACCACTGCCCCTCACCGTCTTCTGA 1547

T416      3201 TTATAGGAGTAACATGTTCATTCCAGGGAAGAATTCCCAACGCAACCCC   3250
               |||||||||||||||||||||||||||||||||||||||||||||||||
AL137471  1548 TTATAGGAGTAACATGTTCATTCCAGGGAAGAATTCCCAACGCAACCCC   1597

T416      3251 AGCAGCAGCATCCACACATCAGAGTCTTGAGGATGACGCTCAGCCTGCAGAT 3300
               ||||||||||||||||||||||||||||||||||||||||||||||||||
AL137471  1598 AGCAGCAGCATCCACACATCAGAGTCTTGAGGATGACGCTCAGCCTGCAGAT 1647

T416      3301 TCCGGTGAAAAGAAGAGAGTTTTCCACCTTTGGAAAGGACTCCCCAAA   3350
               ||||||||||||||||||||||||||||||||||||||||||||||||
AL137471  1648 TCCGGTGAAAAGAAGAGAGTTTTCCACCTTTGGAAAGGACTCCCCAAA   1697

T416      3351 CGATGAGGACACTGGGGATACCAGCACATCATCTGCTCTCGGAAATGA 3400
               ||||||||||||||||||||||||||||||||||||||||||||||||
AL137471  1698 CGATGAGGACACTGGGGATACCAGCACATCATCTGCTCTCGGAAATGA 1747

T416      3401 GCAGTGTGTTCCAGCGTCTCTTACCGCCTTCCCTGGACACCTATTCTGAA 3450
               ||||||||||||||||||||||||||||||||||||||||||||||||||
AL137471  1748 GCAGTGTGTTCCAGCGTCTCTTACCGCCTTCCCTGGACACCTATTCTGAA 1797
```

FIG. 2F

```
T416      3451  TGCAGTGAGGTGGATCGGTTCCAACTCCCTGGAGCGCAGGAAGGGACCCTT  3500
                ||||||||||||||||||||||||||||||||||||||||||||||||||
AL137471  1798  TGCAGTGAGGTGGATCGGTTCCAACTCCCTGGAGCGCAGGAAGGGACCCTT  1847

T416      3501  GCCAGCCAAAACTGTGGGTTACCCACAGGGGGTAGCGGCATGGGCAGCCA   3550
                |||||||||||||||||||||||||||||||||||||||||||||||||
AL137471  1848  GCCAGCCAAAACTGTGGGTTACCCACAGGGGGTAGCGGCATGGGCAGCCA   1897

T416      3551  GTACGCATTTTCAAAATCCCACCACCAACTGTGGGCCCGCCACTTGGAACT  3600
                ||||||||||||||||||||||||||||||||||||||||||||||||||
AL137471  1898  GTACGCATTTTCAAAATCCCACCACCAACTGTGGGCCCGCCACTTGGAACT  1947

T416      3601  CACTCCAGTGTGCAGCCTTCTTCAAAATGGCTGCCAGCCATGGAGGAGAT   3650
                |||||||||||||||||||||||||||||||||||||||||||||||||
AL137471  1948  CACTCCAGTGTGCAGCCTTCTTCAAAATGGCTGCCAGCCATGGAGGAGAT   1997

T416      3651  CCCTGAAAATTATGAGGAAGATGATTTTGACAATGTGCTCAACCACCTCA  3700
                ||||||||||||||||||||||||||||||||||||||||||||||||||
AL137471  1998  CCCTGAAAATTATGAGGAAGATGATTTTGACAATGTGCTCAACCACCTCA  2047

T416      3701  ATGATGGGAAACACGAACTCATGGATGCCAGTGAACTGGTGGCAGAGATT  3750
                ||||||||||||||||||||||||||||||||||||||||||||||||||
AL137471  2048  ATGATGGGAAACACGAACTCATGGATGCCAGTGAACTGGTGGCAGAGATT  2097
```

FIG. 2G

```
T416     3751 AACAAAACTGCTTCAAGATGTCCGCCAGAGCTAGGAGAGATTTTAGCGAAGCA 3800
              ||||||||||||||||||||||||||||||||||||||||||||||||||||
AL137471 2098 AACAAAACTGCTTCAAGATGTCCGCCAGAGCTAGGAGAGATTTTAGCGAAGCA 2147

T416     3801 TTTTGTTTCCATGTATATGGAAATAGGGAACAACAACAACAACAAAAAA 3850
              |||||||||||||||||||||||||||||||||||||||||||||||||
AL137471 2148 TTTTGTTTCCATGTATATGGAAATAGGGAACAACAACAACAACAAAAAA 2197

T416     3851 CCCTGAAAGAACTGGCATTGCCAAATAGTTGCATTTATCATAAATGTGTC 3900
              ||||||||||||||||||||||||||||||||||||||||||||||||||
AL137471 2198 CCCTGAAAGAACTGGCATTGCCAAATAGTTGCATTTATCATAAATGTGTC 2247

T416     3901 TGTGTATATTGAATATTAAATACTGTATTTTCGTATGTACACAATGCAAG 3950
              |||||||||||||||||||||||||||||||||||||||||||||| |||
AL137471 2248 TGTGTATATTGAATATTAAATACTGTATTTTCGTATGTACACAAAAAAA 2297

T416     3951 TGTGATTATTTTAAATCTGTATTTTAAAAATACATTTGTACCTTATATTTA 4000
                                                         |  |||
AL137471 2298 AAAAAAAAAAAAAAAAAAAAAAAAAAAAAAAAAAAAAAAAAG........ 2338
```

FIG. 2H

```
T416    1   ...ATGCACCAAATG..AATGCTAAAATGCACTTTAGGTTTGTTTTGCA       45
m-PC    1   ATGATGCTACTTCTGCCATTCCTGCTCTTAGGGCTCTTAGGGCCAGGAAGCTA    50

T416   46   CTTCTGATAGTATCTTTCAACCACGATGTACTGGGCA.....AGAATTTGAA     92
m-PC   51   CT...TGTTCATTTCAGGGGATTGTCAGGAGGTGGCCACTGTCATGGTGAA      98

T416   93   ATACAGGATTTATGAGGAACAGAGGGTTGGATCAGTAATTGCAAGACTAT      142
m-PC   99   ATTCCAAGTGACAGAGAAGTGCCGTCTGGCACGGTGATAGGGAAACTGT       148

T416  143   CAGAGGATGTGGCTGATGTTTTATTGAAGCTTCCTAATCCTTCTACTGTT      192
m-PC  149   CCCAAGAACT..AAGA.GTGGAGGAGAGGCGTGGGAAGGCAGGAGATG...     193

T416  193   CGATTTCGAGCCATGCAGAGAGGGGGAAATTCTCCTCTACTTGTAGTAAACGA   242
m-PC  194   CCTTCCAGATTC.TGCAGCTGCCTCAGGCACTGCCGGTTCAGATGAACTC      242
```

FIG. 3A

```
T416  243 GGATAAATGGGGAAATCAGCATAGGGGCTACAATTGACCGTGAACAACTGT  292
m-PC  243 TGAGGACGGCCTGCTCAGCACTTCCAGCCGGCTGGATCGGGAGAAGCTAT  292

T416  293 GCCAGAAAAACTTGAACTGTTCCATAGAGTTTGATGTGATCACTCTACCC  342
m-PC  293 GTCGGGCAGGAAGATCCCTGTCTGGTGTCATTTGACGTG.......CTTGCC  336

T416  343 ACA.GAGCATCTGCAGCTTTTCCATATATTGAAGTTGCTGGATATTA  391
m-PC  337 ACAGGGGGCTGTGC.TCTAATTCATGTGGAGATTCAGGTGCTAGACATCA  385

T416  392 ATGACAATTCTCCCCAGTTTTCAAGATCTCTCATACCTATTGAGATATCT  441
m-PC  386 ATGACCACCAGCACCACAGTTTCCCAAAGAGAGCAGGAACTGGAAATCTCA  435

T416  442 GAGAGTGCAGCAGTTGGGACTCGCATTCCCCTGGACAGTGCATTTGATCC  491
m-PC  436 GAGAGTGCCCTCTCTGCACACGAATCCCCTTGGACAGAGCTCTTGACCA  485
```

FIG. 3B

```
T416  492 AGATGTTGGGGAAAATTCCCTCCACACATACTCGCTCTCTGCCAATGATT 541
              ||||||    ||||  |||||| |||||  ||  |||||||| ||
m-PC  486 AGACACGGGTCCTAACAGCTTATATTCCTACTCCCGTCTCCCAGTGAAC 535

T416  542 TTTTTAATATCGAGGTTCGGACCAGGACTGATGGAGCCAAGTATGCAGAA 591
              ||||  || ||||| |||| ||||| |||||||||||| |||||||
m-PC  536 ACTTTGCCCTGATGTTATTGTGGGCCCTGATGAGACATGCAGAG      585

T416  592 CTCATAGTGGTCAGAGAGTTAGATCGGGAGCTGAAGTCAAGCTACGAGCT 641
              |||  |||||||   ||| ||||  ||||  || ||||| |   |||
m-PC  586 CTTGTGGTGGTGAAGGAGTTGGACAGGGAACTCCACTCATATTTTGATCT 635

T416  642 TCAGCTCACTGCCTCAGAC.ATGGGAGTACCTCAGAGGTCTGGCTCATCC 690
              ||||||||  |||  ||| |||||| || ||  ||||  |||  ||||
m-PC  636 GGTGCTGACCGCCTATGACAATGGGAAT.CCCCCTAAGTCAGGAATCAGC 684

T416  691 ATACTAAAAATAAGCATTTCAGACTCCAATGACAACAGCCCTGCTTTTGA 740
              ||| ||| || ||  || ||  |||||||||| ||||||||| |||
m-PC  685 GTGGTCAAGGTCAATGTCCTGGACTCCAATGACAATAGTCCAGTGTTTGC 734
```

FIG. 3C

```
T416  741 GCAGCAATCTTATATATAATACAACTCTTAGAAAAACTCCCCGGTTGGCACTT  790
          |||||  ||| || |  ||| |||| |||||||  ||   |||||| ||| |
m-PC  735 TGAGAGTTCACTAGCACTAGAAATCCCAGAGAACACTGTTCCTGGTACTC    784

T416  791 TGCTCTCTTAGAGATCTGAAATGCCACGGATCCAGATGAGGGGCTAATGGGAAA  840
          || ||| |||||| |||||| |||| ||||||||| || || |||||| || 
m-PC  785 TTCTCATAAACCTGACTGCTACAGATCCCGACCAAGGACCCAATGGGGAG    834

T416  841 ATTGTATATTCCTTCAGCAGTCATGTGTCTCCCAAAATTATGGAGACTTT  890
          ||||||  ||| |||||||| || |||||| ||||| || |||||||
m-PC  835 GTAGAGTTCTTCTTTGGCAAGCATGTGTCCCCAGAGGTGATGAACACCTT  884

T416  891 TAAAATTGATTCTGAAAAGAGGACATTTGACTCTCTTTTCAAGCAAGTGGATT  940
          |  ||||| || |||||| ||| ||||||||| || | ||||||  ||| ||
m-PC  885 TGGCATAGATGCCAAGACAGGCCAGATCATTCTGCGCCAAGCCCTAGATT    934

T416  941 ATGAAAATCACCAAATCCTATGAGATTGATGTTCAGGCTCAAGATTTGGGT  990
          || || |||  |   ||| ||||  |||||| ||||| |||||| |||||
m-PC  935 ACGAGAAGAACCCTGCCTATGAGGTGGATGTCCAGGCAAGGGATTTGGGT  984
```

FIG. 3D

```
T416   991 CCAAATTCAATCCCAGCCCCATTGCAAAATTATAATTAAGGTTGTGTGGATGT 1040
            ||||||||||.||||.||||||||||||||||.||||||||||.|.||||||
m-PC   985 CCCAATTCCATCCCCAGGCCCATTGCAAAGTTCTTATCAAAGTTCTGGATGT 1034

T416  1041 TAATGACAATAAACCTGAAATTAACATCAACCTCATGTCCCCTGGAAAAG 1090
            ..|||||||...|||.     |||.|||||||||||||     ||||||
m-PC  1035 CAATGACAATGCCCC......AAGCATCCTCATCACGT.....GGGCCTCC 1074

T416  1091 AAGAAATATCTTATATTTTTGAAGGGGATCCTATTGATACATTTGTTGCT 1140
            |||    ||.||      |||.||||||||..||||||||||||.||||
m-PC  1075 CAGACGTCGCT..GGTGTCAGAAGATCTTCCCAGGGATAGCTTCATTGCC 1122

T416  1141 TTGGTCAGAGTTCAGGACAAGGATTCTGGGCTGAATGGAGAAATAGTTTG 1190
            ||.|||||.|||||||.||.||||||||||||||||.||||||||||||
m-PC  1123 CTTGTCAGTGCGAATGACTTGGACTCAGGAAACAACGGTCTCGTCCACTG 1172

T416  1191 TAAGCT...TCATGGACATGGTCACTTTAAACTTCAGAAGACATATGAAA 1237
            |||.||   |||.|.||||.||||.||||||||||.|.|||.|||....
m-PC  1173 TTGGCTGAATCAAGAGCTGGGCCACTTCAGACTGAAAAGGACTAACGGCA 1222
```

FIG.3E

```
T416  1238 ACAATTATTTAAATCTTAACTAATGCCACACTGGATAGAGAAAAGAGATCT 1287
             |||  ||| ||  ||  |||||||||||||| ||||| ||||||
m-PC  1223 ACACGTACATGCTGCTCACCAATGCCACACTGGACAGAGAGCAGTGGCCC 1272

T416  1288 GAGTATAGTTTGACTGTAATCGCTGAGGACAGGGGACACCCAGTC..TC  1335
             ||||| ||||| |||| | ||||| ||||| ||| ||    ||
m-PC  1273 ATATATACTCTCACTGTGTTTGCCCAAGAC.CAAGGAC.CCCAGCCCTTA 1320

T416  1336 TCTACAGTGAAACATTTACAGTTCAAATCAATGATATCAATGACAATCC  1385
             ||||||||||  | ||||||||||| |||| | || ||||||| ||
m-PC  1321 TCAGCTGAGAAGGAGCTCCAAATTCAGGTTAGTGATGTCAATGACAATGC 1370

T416  1386 ACCCCCACTTCCAGAGAAGCCGATATGAATTTGTAATTTCAGAAAATAACT 1435
             ||| | ||||| ||||| || |||| ||   ||||||||||||| |||
m-PC  1371 CCCTGTGTTTGAGAAGAGCCGGTACGAGAGGTCTCCACTTGGGAAAATAACC 1420

T416  1436 CACCAGGGGCATATATCACCACTGTTACAGCCACAGATCCTGATCTTGGA 1485
             ||||||| ||||||   | |  |||  ||||| || |||   |||||
m-PC  1421 CACCCTCTCTTCACCTCATCACGCTCAAAGCGCATGATGCTGACTTGGGC 1470
```

FIG. 3F

```
T416  1486  GAAAATGGGCAAGTGACATACACCATCTTGGA.GAGTTTTATTCT.AGGA  1533
             ||||| ||||||||| ||||| || |||  ||| ||||| | ||| | ||
m-PC  1471  AGTAATGGAAAAGTGTCATACCGTATCAAGGACTCCCCCGTTTCTCACTT  1520

T416  1534  AGTTCCATAACTACATATGTAACCATTGA...CCCATCTAATGGAGCCAT  1580
             ||| ||  |||| |  |||  | ||||||   | ||| | ||||| | |
m-PC  1521  AGT..CATTATTGACTTTGAAACAGGAAGTCACTGCTCAGAGGTCACT   1568

T416  1581  ...CTATGCCC....TCAGAATCTTTGA..TC....ATGA.AGAAGTGAGTC  1618
                ||||| |     ||| |||  |||   |     |||| ||||||   |
m-PC  1569  GGACTATGAACAGATGGCAGGCTTTGAGTTCCAGGTGATAGCAGAG.GAC  1617

T416  1619  AGATCAC.TTTTGTGGTAGAAGCAAGAGATGGAGGAAGCCCGAAGCAACT  1667
             || ||| |  |||||   ||||| || |||| | ||| ||||||| || |
m-PC  1618  AGAGGGCAACCCCAGCTCGCATCCAG.CATCTCGGTGTGGGTTAGCCTCT  1666

T416  1668  GGTAAGC.......AATACCACAGTTGTG.CTCACC.....ATCATTGAC  1704
             ||| ||         ||  || ||| ||| ||| ||     || |||||
m-PC  1667  TGGATGCCAATGATAATGCCCAGAAGTGATTCAGCCTGTGCTCAGTGAA  1716
```

FIG. 3G

```
T416   1705 GAAAAATGACAACGTTCCTGTGGTTATA............GGGCC.........  1736
            |||||||||||||||||||||||||||                |||||
m-PC   1717 GGCAAAGCCACCCTTTCGGTGCTTGTAAATGCCTCCACGGGCCACCTTCT       1766

T416   1737 ..TG...CATTGCGTA..........AT.AATACGGCAGAAATCACCATTC      1771
              ||    |||||||            || |||||||||| | |||||||
m-PC   1767 GTTGCCCATTGCGTAGAATTGAGAATCCCAGTGGCATGGATCCAGCAGGTACTGGTATAC 1816

T416   1772 ..CCAAAGG.GGCTGAAAG....TGG.CTTT.CATGTCACAAGAATAAGG       1812
              ||||||| ||||||||    ||| ||||  ||||||||||||||||||
m-PC   1817 CACCAAAGGCTACCCCAGCCCCCTGGTCTTTCCTTTGTTAACAATCGTG            1866

T416   1813 GCAATTGACAGAGACTCTGGTGTGAATGCTGAACTCAGCTGCGCCATAGT       1862
            ||||||||||||||||||||||||||||||||||||||||||||||||||
m-PC   1867 GCTAGGGATGCAGAGACTCGGGGGCCAATGGGAACTCTTCTACAGCATTCA          1916

T416   1863 AGCAGGTAAATGAGGAGAATATCTTCATAATTGATCCACGATCATGTGACA      1912
            |||||||||||||||||||||||||||||||||||||||||||||||||||
m-PC   1917 AAGTGGGAATGATGCTCATCTCTT.TTTCCTCAGCC.CTTCCTTGGGGCA          1964
```

FIG. 3H

```
T416  1913  TCCAT..ACCAACGTTAGC.ATGGATTCTGTGTTCCCTACACAG..AATGGG  1957
            |||||  ||||||||||||  ||||||||| |||||| | |||||||  |||||
m-PC  1965  GCTATTCATTAATGTCACCAATGCCAGCCTCATCGGGAGTCAGTGGG  2014

T416  1958  AGCTGTCAGTTATCATTCAGGACAAAGGCAATCCTCAGCTACATACCAAA  2007
            | |||||||| |||||||||| ||||| || ||||||  | | |||||
m-PC  2015  ACCTGGGGATAGTGGTAGAGGACCAGGGCAGCCCCTCCTTGCAGACCCAA  2064

T416  2008  GTCCTTTCTGAAGTGCATGATCTTTGAATATGCAGAGTCGGTGACAAGTAC  2057
            ||  |||| ||||| ||| | |  || || |||||||  |||| ||
m-PC  2065  GTTTCATTGAAGGTCGTG...TTTG..TCACCAGTGT..GGACCACCTAA  2107

T416  2058  AGCAATGACTTCAGTAAGCCAGGCATCCTTGGATGTCTCCATGA.TAATA  2106
            |||||||| |||||| ||||||||  |||||||||| | ||||  ||||
m-PC  2108  GGGATTCTGCTCA.TGAGCCCGGGAGTTCT..GAGCACCAGCACTGGCT  2154

T416  2107  ATTATTCCTTAGGAGCAATTGTGCAGTGTTGCTGGTTATTATGTGCT  2156
            | ||| ||| |||| ||| |||||| |||||||| | | |||||||
m-PC  2155  TTGATCTGCCTGGCTGTACTGCTGGCCATCTTTGGATTGCTCTTAGCCCT  2204
```

FIG. 3I

```
T416   2157  ATTTGCAACTAGTGTGTAACCGCGAGAAGAAAGACACTAGATCCTATAACT  2206
              |  ||||||  ||  |||| | ||||| ||| |  ||||||  ||||| |
m-PC   2205  GTTCGTGTCCATCTGCAGGACAGAGAAGGATAATAGGGCCTACAACT      2254

T416   2207  GCAGGGTGGCCGAATCAACTTACCAGCACCACCCAAAAAGGCCATCCCGG  2256
              ||||| |||||||| ||| |||||||||| ||||||||| ||||| |||
m-PC   2255  GTCGAGAAGCTGAGTCGTCATACCGCGCCACCAGCGCCCCAGAAA        2304

T416   2257  CAGATTCACAAAGGGGACATCACATTGGTGCCTACCATAAATGCACTCT   2306
              ||| ||||||||||| | ||||||  | |||||| ||||  |||| |
m-PC   2305  CACATTCAGAAGGCAGATATCCACCTGGTGCCTGTGCT.TAGGGCCCAC.  2352

T416   2307  GCCCATCAGATCTCATCA...CAGATCGTCTC..CATCTTCATCTCCTA..  2350
              ||||||||||||||||||    |||| | ||   |||||||| ||||
m-PC   2353  GAGAATGAGA.CTGATGAAGT.CAGGCCATCAGGCCATCTCACAAGGATACCAGCAAGG  2401

T416   2351  ..CCTTAGAAAGAGGGCAGATGGG........CAGCCGGCAGAGTCACAA  2390
                   ||| || |||| |||             ||| ||||||| | |
m-PC   2402  AGACACTGATGGAGGCAGGCTGGGACTCTTGCCTGGAGGCCCCCTTCCAC  2451
```

FIG. 3J

```
T416   2391  CAGTCACCAGTCACTCAACAGTTTGGTGACAATCTCATCAAACCACG...    2437
              ||||  |||  || | ||||  |||  ||||||||  |||||||||
m-PC   2452  CTCACACCA..ACCCTATACAGGACCCTGCGTAACCAAGGCAACCAGGGAG  2500

T416   2438  ...TGCCAGA........GAATTTCT.CATTAGAAAC.TCACC...CACGCC  2472
                 |||||||        | ||| | ||  |||||  |||||   |||||
m-PC   2501  AACTGGCAGAGAGCCAGGAGGTACTGCAGGACACCTTCAACTTTCTCTTT  2550

T416   2473  ACTCCTGC...TGTTGA.GCAGGTCTCTC...AGCTTCT....TTCAATGC  2512
             |||||  |   || |   |||||    |   ||   |    ||  ||||
m-PC   2551  AACCATCCCAGGCAGAGAATGCCTCCCGGGAGAACCTAAACCTTCCTGA   2600

T416   2513  TTCACCAGGGGCAATA..TCAGCCAAGACCAAG...TTTTCGAGGAAAACAA  2558
             |   |||||  ||||   |||||| | | |||   ||| |||||  |
m-PC   2601  GTCCCCACCTGCTGTACGCCCAACCACTCTTAAGGCCCTCTGAAGGTGCCTG  2650

T416   2559  ATATTCCAGGAGCTACAGATA.TGCCCTTCAAGACATGGACAAATTTAGC  2607
              |  ||||   ||  |||||  || |  ||||||||||  ||||
m-PC   2651  GTAGCCCCATAGCGAGGGCGACTGGAGACCAAGACAAGGAGGA.....GGC  2696
```

FIG. 3K

```
T416  2608 TTGAAAGACAGTGGCCGTGGTGACAGTGAGGC..AGGAGACAG.TGATTA 2654
              ||| |||||  ||| ||  ||  ||| |||  |||| |||| |||||
m-PC  2697 CCCACAGAGCCCACCAGCGTCCTCTGCAACCCTAAGACGACAGCGGAATT 2746

T416  2655 TGATTTGGGGCGAGATTCTCCAATA.GATAGGCTGCTGGGTGAAGGATTC 2703
              | ||||   |||| || ||| |  | |||||| |||||||| ||||||
m-PC  2747 TCAAT..GGCAAAGTGTCTCCTAGAGGAGAGTCCGGTCCTCATCAGATTC 2794

T416  2704 ..AGCGACCTGTTT....CTCACAGATGGAAGAATTCCAGCAGCTATGAGA 2748
             ||  || ||||    |||||||| |||||||||||||||||||| ||
m-PC  2795 TGAGGAGCCTGGTTAGGCTCTCTG.TGGCTGCTTTTGCGGA....ACGGAA 2840

T416  2749 CTCTGCACGGAGGAG..TGCAGGGTCCTGGGACACTCTGACCAGTGCTGG 2796
              |||||  |||||||  ||| ||| ||||||||| |||||||||| |||
m-PC  2841 CCCGG..TGGAGGAGCCTGCTGGGGACT..CTCCTCCTGTCCAGCAAATC 2886

T416  2797 ATGCCACCACTGCCCTCAC.....CGTCTTCTGATTATAGGAGTAACATGT 2842
              |||||||| ||||| ||       |||   ||||||| ||||| |||
m-PC  2887 TCCCAGCTGCTGTCCTTGCTGCACCAGGGCCCAATTCCAGCCCCAAACCAAA 2936
```

FIG. 3L

```
T416  2843  TCATTCCAGGGGAAGAATTCCCAACGCAACCCCAGCAGCATC......  2887
             |||  |||    ||||| ||||    |||   ||||||||||
m-PC  2937  CCA..CCGGAGGAAATAAATACTTGGCCAAGCCCGGCAGCAGGGG    2984

T416  2888  .CACATCAGAGTC.TTGAGGATGACGCTCAGCCTGCAGATTCCGGTGAAA  2935
             |||||||||||| ||||| || ||||||||| ||  || ||||||||
m-PC  2985  TACCATCCCAGACACAGAGGGGCCTTG.TAGGCCTCAAGCCT.AGTGGCCA  3032

T416  2936  AGAAGAAGAGTTTTTCCACCTTTGGAAAGGACTCCCCAAACGATGAGGAC  2985
             | ||||                 |||||  |||||||||| ||||
m-PC  3033  AGCAGAA.......CCTGACCTGGAAGAAGGGC.CCCGAGCCCGGAGGA.  3074

T416  2986  ACTGGGGATACCAGCACACATC.ATCTCTGCTCTCGGAAATGAGCAGTGT  3034
             |||||| |||||||  ||||| |||  || || |||||||||||||||
m-PC  3075  ...GGACCTTTCTGTAAAGCGACTTCTAGAAGAAGCTGTCGAGCCTGT    3121

T416  3035  TCCAGCGTCTCTTACCGCCTTCCCTGACA..CCTATTCTGAATGCAGTG  3082
             ||||| ||||| || || |||||||||    ||||||||||||| |
m-PC  3122  TGGACCCTAATACAGGTCTAGCCCTGGACCCTGAGTCCGCCTGACCCA  3171
```

FIG. 3M

```
T416  3083  AGGTGGATCG.GTCCAACTCCCTGGAGCGCAGGAAGGGACCCTTGCCAGC  3131
             |||||||||| |||||||||||||||||||||||||||||||||||||
m-PC  3172  GCCTGGATGGCGAGATTGTCATTGCCCCTCA......CCACCAATTATCGA  3216

T416  3132  CAAAACTGTGGGTTACCCACAGGGGTAGCGGCATGGGCCAGCCAGTACGC  3181
             |||||||| ||||     ||||||     ||||| |||||||||||
m-PC  3217  GACAACT.TGTCTTCCCCGATGCTACAACATCAGAGGAACCGAGAAC..  3263

T416  3182  ATTTTCAAAATCCCACCACCAACTGTGGGCCGCCACTGGAACTCACTCC  3231
             ||||||||| |||     |||||| ||||||||||||||||||||||
m-PC  3264  .CTTCCAGACATTCGGCAAGACAGTTGGACCGGGAC..CCGAGCTGAGCCC  3311

T416  3232  AGTGTGTGCAGCCCTTCTTCAAAAATGGCTGCCAGCACTTTCGTCTCTGC  3279
             |||||||||||||||||||||||||||||||| |||||||||||||||
m-PC  3312  AACAGGCACGCGCCTGGCCAGCACTTTCGTCTCGGAGATGAGCTCTCTGC  3361

T416  3280  ..GAAA..ATTATGAGGAAGATGATTTTGACAATG..TGCT.CAACCACC  3322
               ||||  ||||||||||||||||||||||||||   |||| ||||||||
m-PC  3362  TGGAAATGTTGTTGGGGCAGCACGGTACCAGCAGTGGAAGCTGCGGTCCGCG  3411
```

FIG. 3N

```
T416  3323 TCAATGATGGGAAACACGAACTCATGGATG.....CCAGT...GA...... 3359
            |||||||||||||||||||||||||||||||     |||||   ||
m-PC  3412 GCTTTGCGGAGGCTCTCGGTGTGCGGAGGACCCCTCAGTCTAGACCTAGC 3461

T416  3360 ....ACTGGTGGCAGAGATTAACAA..ACTGCTT..CAAGATGTCCGC..C 3400
               |||||||||||||||||||||  |||||||  |||||||||||  |
m-PC  3462 CACCAGTGGGGCTTCAGCTTCAGAAGCACAGGGTAGAAAGAAGGCAGCTG 3511

T416  3401 AGAGC............................. 3405
           |||||
m-PC  3512 AGAGCAGACTTGGCTGTGGCAGGAATCTA 3540
```

FIG. 30

| | | | |
|---|---|---|---|
| m-PC | 1 | MMLLLPFLLGLLGPGSYLFISGDCQEVATVMKFQVTEEVPSGTVIGKLS | 50 |
| T416 | 1 | .MHQMNAKMHFRFVFALLIVSFN.HDVLGKNLKYRIYEEQRVGSVIARLS | 48 |
| m-PC | 51 | QELR..VEERRGKAGDAFQILQLPQALPVQMNSEDGLLSTSSRLDREKLC | 98 |
| T416 | 49 | EDVADVLLKLPNPSTVRFRAMQRGNSPLLVVNEDNGEISIGATIDREQLC | 98 |
| m-PC | 99 | RQEDPCLVSFDV..LATGASALIHVEIQVLDINDHQPQFPKDEQELEISE | 146 |
| T416 | 99 | QKNLNCSIEFDVITLPTEHLQLFHIEVEVLDINDNSPQFSRSLIPIEISE | 148 |
| m-PC | 147 | SASLHTRIPLDRALDQDTGPNSLYSYSLSPSEHFALDVIVGPDETKHAEL | 196 |
| T416 | 149 | SAAVGTRIPLDSAFDPDVGENSLHTYSLSANDFFNIEVRTRTDGAKYAEL | 198 |
| m-PC | 197 | VVVKELDRELHSYFDLVLTAYDNGNPPKSGISVVKVNVLDSNDNSPVFAE | 246 |
| T416 | 199 | IVVRELDRELKSSYELQLTASDMGVPQRSGSSILKISISDSNDNSPAFEQ | 248 |

FIG. 4A

```
m-PC  247 SSLALEIPEDTVPGTLLINLTATDPDQGPNGEVEFFFGKHVSPEVMNTFG 296
          ::  ..  |||||  ||||  ||  .||  ||  |||.:  ||||
T416  249 QSYIQLLENSPVGTLLLDLNATDPDEGANGKIVYSFSSHVSPKIMETFK  298 m-PC  297 IDAKTGQIILRQALDYEKNPAYEVDVQARDLGPNSIPGHCKVLIKVLDVN 346
          ||.  ||.|||||||||  ..|||||||||||.|  |||||  ||||||
T416  299 IDSERGHLTLFKQVDYEITKSYEIDVQAQDLGPNSIPAHCKIIIKVVDVN 348 m-PC  347 DNAPSILITWAS....QTSLVSEDLPRDSFIALVSANDLDSGNNGLVHCW 392
          ||  ::  ||       :||  ||  ||  :|  |||  ||||||.|
T416  349 DNKPEININLMSPGKEEISYIFEGDPIDTFVALVRVQDKDSGLNGEIVCK 398 m-PC  393 LNQELGHFRLKRTNGNTYMLLTNATLDREQWPIYTLTVFAQDQGPQPLSA 442
          |  .|||.  ||||||||.||||||||||||  ||||||.|..|.|
T416  399 LHGH.GHFKLQKTYENNYLILTNATLDREKRSEYSLTVIAEDRGTPSLST 447 m-PC  443 EKELQIQVSDVNDNAPVFEKSRYEVSTWENNPPSLHLITLKAHDADLGSN 492
          .|  ||||.|  ||||||  :||||  ::  |||||||||..|..||
T416  448 VKHFTVQINDINDNPPHFQRSRYEFVISENNSPGAYITTVTATDPDLGEN 497
```

FIG. 4B

```
m-PC   493 GKVSYRIKD......SPVSHLVIIDFETGEVTAQRSLDYEQMAGFEFQVIA  537
           .|.|.:         ||:|  |   |  .:|.:
T416   498 GQVTYTILESFILGSSITTYVTIDPSNGAIYALRIFDHEEVSQITFVVEA  547 m-PC   538 EDRGQP.QLASSISVWVSLLDANDNAPEVIQPVLSEGKATLSVLVNASTG  586
           | ||.| ||.:: |.:|| .|:| : | |  |::  |.
T416   548 RDGGSPKQLVSNTTVVLTIIDENDNVPVVIGPALRNNTAEITIPKGAESG  597 m-PC   587 HLLLPIENPSGMDPAGTGIPPKATHSPWSFLLLTIVARDADSGANGELFY  636
                                          .|  |||| |||.|:
T416   598 ..............................FHVTRIRAIDRDSGVNAELSC  618 m-PC   637 SIQSGNDAHLFFLSPSLGQLFINVTNASSLIGSQWDLGIVVEDQGSPSLQ  686
           .| .|:: .:|| |  |:|||:.:  .. ::: :||  |:
T416   619 AIVAGNEENIFIIDPRSCDIHTNV.SMDSVPYTEWELSVIIQDKGNPQLH  667 m-PC   687 TQVSLKVV...FVTSVDHLRDSAHEPGVLSTPALALICLAVLLLAIFGLLL  733
           |:| ||.:   |.:.|  :.:|| .| .:|||:: :|.:|.: :
T416   668 TKVLLKCMIFEYAESVTSTAMTSVSQASLDVSMIIISLGAICAVLLVIM   717
```

FIG. 4C

```
m-PC    734  ALFVSICRTERKDNRAYNCREAESSYRHQPKRPQKHIQKADIHLVPVLRA   783
             ||| ::|||:||:|||:|||||:||:|||||:| :|   |:|||:||:
T416    718  VLFATRCNREKKDTRSYNCRVAESTYQHHPKRPSRQIHKGDITLVPTING  767 m-PC    784  HENETDEVR...PSHKDTSKETLMEAGWDSCLEAPFHLTPTLYRTLRNQGN  831
                          |::|:|:    :| :  |:    |:::    ::
T416    768  TLPIRSHHRSSPSSSPTLERGQMGSRQSHNSHQSLNSLVTISSNHVPENF  817 m-PC    832  QGELAESQEVLQDTFNFLFNHPRQRNASRENLNLPESPPAVRQPLLRPLK   881
             ::|  |:  |:  |    :|| :   :: |: : | |||||:| ||:||
T416    818  SLELTHATPAVEQVSQLLSMLHQGQYQPRPSFRGNKYSRSRYRYALQDMDK  867 m-PC    882  VPGSPIARATGDQDKEEAPQSPPASSATLRRQRNFNGKVSPRGESGPHQI   931
             :|||  :: :||:|: :  :|| | || ||:|| :|||:|:|| | ||:
T416    868  FS....LKDSGRGDSEAGDSDYDLGRDSPIDRLLGEGFSDLFLTDGRIPA  913 m-PC    932  LRSLVRLSVAAFAERNPVEEPAGDSPPVQQISQLLSLLHQGQFQPKPNHR   981
             :|||  |:    ||:|| | |:||:::||::||:|:::||||:||::||
T416    914  AMRLCTEECRVLGHSDQCWMPPLPSPSSDYRSNMFIPGEEFPTQPQQQHP  963
```

FIG. 4D

```
m-PC    982  GNKYLAKPGGSSRGTIPDTEGLVGL.KPSGQAEPDLEEGPPSPEEDLSVK  1030
T416    964  HQSLEDDAQPADSGEKKKSFSTFGKDSPNDEDTGDTSTSSLLSEMSSVFQ  1013 m-PC   1031  RLLEEEL....SSLLDPNTGLALDKLSPPDPAWMARLSLPLTTNYRDNLSS  1077
T416   1014  RLLPPSLDTYSECSEVDRSNSLERRKGPLPAKTVGYPQGVAAWAASTHFQ  1063 m-PC   1078  PDATTSEEPRTFQTFGKTVGPGPELSPTGTRLASTFVSEMSSLLEMLLGQ  1127
T416   1064  NPTTNCGPPLGTHS...SVQPSSKWLPAMEEIPENYEEDDFDNVLNHLND  1110 m-PC   1128  HTVPVEAASAALRRLSVCGRTLSLDLATSGASASEAQGRKKAAESRLGCGRNL  1180
T416   1111  GKHELMDASELVAEINKLLQDVRQS........................   1135
```

FIG. 4E

```
GAAGTTGAAG  TGAAAGTTTA  ATAAGCAAAA  GAAGAAAGCA  CTCCACTGCA  GAGAGGGGGC       2246
            ||||||||||  ||||||||||  ||||||||||  ||||||||||  ||||||||||
GAAGTTGAAG  TGAAAGTTTA  ATAAGCAAAA  GAAGAAAGCA  CTCCACTGCA  GAGAGGGGGC     121136

CCAAAAGAGG  GTTGCCATTT  CACAGCTGAA  TACAAAGGCA  TAAGGCACAC  ATTTCTGGTA       2186
            ||||||||||  ||||||||||  ||||||||||  ||||||||||  ||||||||||
CCAAAAGAGG  GTTGCCATTT  CACAGCTGAA  TACAAAGGCA  TAAGGCACAC  ATTTCTGGTA     121196

GCTCCACCCC  ATCCTCGTAG  TGTGCATGCA  AGCCCTTAGC  TTGAGTTACT  CCATGTGGCT       2126
            ||||||||||  ||||||||||  ||||||||||  ||||||||||  ||||||||||
GCTCCACCCC  ATCCTCGTAG  TGTGCATGCA  AGCCCTTAGC  TTGAGTTACT  CCATGTGGCT     121256

TTGTTCCCCT  TACTGTGCAT  GTGTCAGGGG  ATGGAATTTT  CTATTGTGAG  CATGTCTAGG       2066
            ||||||||||  ||||||||||  ||||||||||  ||||||||||  ||||||||||
TTGTTCCCCT  TACTGTGCAT  GTGTCAGGGG  ATGGAATTTT  CTATTGTGAG  CATGTCTAGG     121316

CAAGTCTCCT  GTGTAGCCTT  GTTTTAATGT  ATGTGGCTGT  GGGCATGTTT  TAGGCAAGCC       2006
            ||||||||||  ||||||||||  ||||||||||  ||||||||||  ||||||||||
CAAGTCTCCT  GTGTAGCCTT  GTTTTAATGT  ATGTGGCTGT  GGGCATGTTT  TAGGCAAGCC     121376

CCCCTGTACA  AGTTCCCTTA  TCTGCAGTTT  GATTTTTCAG  GCTGTTCTTT  TGTTTGAAGG       1946
            ||||||||||  ||||||||||  ||||||||||  ||||||||||  ||||||||||
CCCCTGTACA  AGTTCCCTTA  TCTGCAGTTT  GATTTTTCAG  GCTGTTCTTT  TGTTTGAAGG     121436
```

Fig. 6A

```
AATTTGACTG  AGGGCCCACC  CTAACTGCCT  GCCTGACTAG  TTTCTTCCTT  CCTCCTCTCT    1886
            ||||||||||  ||||||||||  ||||||||||  ||||||||||  ||||||||||
AATTTGACTG  AGGGCCCACC  CTAACTGCCT  GCCTGACTAG  TTTCTTCCTT  CCTCCTCTCT  121496

CAATAGCACC  TGAATATCAG  AACCAGAGAA  AGCAAGAAA   TATGACAACA  GTCACAAATA    1826
            ||||||||||  ||||||||||  ||||||||||  ||||||||||  ||||||||||
CAATAGCACC  TGAATATCAG  AACCAGAGAA  AGCAAGAAA   TATGACAACA  GTCACAAATA  121556

CCACAAGAAA  CATTTGAAAA  CCACTTTTTA  TCCAGTTTTC  TCATGGCCTA  GATCCAACAG    1766
            ||||||||||  ||||||||||  ||||||||||  ||||||||||  ||||||||||
CCACAAGAAA  CATTTGAAAA  CCACTTTTTA  TCCAGTTTTC  TCATGGCCTA  GATCCAACAG  121616

GAATAAGTCC  CGTGAATCTA  AATGGCCAAC  TTTAGATAAA  GGGCCATTTT  TCTTAATTGA    1706
            ||||||||||  ||||||||||  ||||||||||  ||||||||||  ||||||||||
GAATAAGTCC  CGTGAATCTA  AATGGCCAAC  TTTAGATAAA  GGGCCATTTT  TCTTAATTGA  121676

CTGATTATTC  CACTTCTCCT  AAATTATTTA  TAATGAGATG  TACTGGCTGT  TGTGCAGATT    1646
            ||||||||||  ||||||||||  ||||||||||  ||||||||||  ||||||||||
CTGATTATTC  CACTTCTCCT  AAATTATTTA  TAATGAGATG  TACTGGCTGT  TGTGCAGATT  121736

TTGCCTTGAC  AGGCCCATAA  ATAATTGAGG  GCCCTTTTAT  TATCTAAAAC  TATTTTAACC    1586
            ||||||||||  ||||||||||  ||||||||||  ||||||||||  ||||||||||
TTGCCTTGAC  AGGCCCATAA  ATAATTGAGG  GCCCTTTTAT  TATCTAAAAC  TATTTTAACC  121796
```

Fig. 6B

```
AACACATTTA CATAGGTCTC TTGGGCCTCT AAAGCTTGAG CTGTTTTATT TACTATTTGG    1526
           |||||||||| |||||||||| |||||||||| |||||||||| |||||||||| ||||||||||
AACACATTTA CATAGGTCTC TTGGGCCTCT AAAGCTTGAG CTGTTTTATT TACTATTTGG  121856

GCCATAGTCA GGGATAAAAA TGTTTAGAAA CATGTTTTAG TTTAGAAATA CCTAGTGAGG    1466
           |||||||||| |||||||||| |||||||||| |||||||||| |||||||||| ||||||||||
GCCATAGTCA GGGATAAAAA TGTTTAGAAA CATGTTTTAG TTTAGAAATA CCTAGTGAGG  121916

GTTAGAAATT CTTAGTCAAA CTAGTGAGAT CTGGTGGTCA GTTATTGATC AGATAAAATA    1406
           |||||||||| |||||||||| |||||||||| |||||||||| |||||||||| ||||||||||
GTTAGAAATT CTTAGTCAAA CTAGTGAGAT CTGGTGGTCA GTTATTGATC AGATAAAATA  121976

TGAGGAATTC CCCTCTCTAA GCCATAGTTT CTAAATGTGT GAGAAAAACA AGCAGTCCAC    1346
           |||||||||| |||||||||| |||||||||| |||||||||| |||||||||| ||||||||||
TGAGGAATTC CCCTCTCTAA GCCATAGTTT CTAAATGTGT GAGAAAAACA AGCAGTCCAC  122036

ACATAGTTCA GGGCCTGGTC TGAACACTAA AGTCTGGTTC ATTCACAGAG ATATAATACT    1286
           |||||||||| |||||||||| |||||||||| |||||||||| |||||||||| ||||||||||
ACATAGTTCA GGGCCTGGTC TGAACACTAA AGTCTGGTTC ATTCACAGAG ATATAATACT  122096

TGTTTAGTAT GGAGAAAGAG AGGGAGGCTT TACAACACAT CACCCCAGAG TCACAAACCA    1226
           |||||||||| |||||||||| |||||||||| |||||||||| |||||||||| ||||||||||
TGTTTAGTAT GGAGAAAGAG AGGGAGGCTT TACAACACAT CACCCCAGAG TCACAAACCA  122156
```

Fig. 6C

```
CCATACAGAG  GTCAGATGGT  ATGTGACAGC  TAGGTCCTCT  GTGATAGGAA  ACTGGATTGG    1166
||||||||||  ||||||||||  ||||||||||  ||||||||||  ||||||||||  ||||||||||
CCATACAGAG  GTCAGATGGT  ATGTGACAGC  TAGGTCCTCT  GTGATAGGAA  ACTGGATTGG  122216

AACACAGCCA  ACATTCCCAA  CACCTGATGG  TGAAGAGGGA  CTGACAAAGT  CCTTTCCAGC    1106
||||||||||  ||||||||||  ||||||||||  ||||||||||  ||||||||||  ||||||||||
AACACAGCCA  ACATTCCCAA  CACCTGATGG  TGAAGAGGGA  CTGACAAAGT  CCTTTCCAGC  122276

AGGCCTGTCC  CTTGAGGCTT  GTAAGGTTGG  CAGCAGCTGC  TCTAAAAGCT  TTTTACTAGC    1046
||||||||||  ||||||||||  ||||||||||  ||||||||||  ||||||||||  ||||||||||
AGGCCTGTCC  CTTGAGGCTT  GTAAGGTTGG  CAGCAGCTGC  TCTAAAAGCT  TTTTACTAGC  122336

CCAAGACACA  GGGCTGAACT  TTGCTTTGGA  GCCCCTTACC  TTTTTCCAAG  GAATCAAAAC     986
||||||||||  ||||||||||  ||||||||||  ||||||||||  ||||||||||  ||||||||||
CCAAGACACA  GGGCTGAACT  TTGCTTTGGA  GCCCCTTACC  TTTTTCCAAG  GAATCAAAAC  122396

AATTAATAAA  ACCAGTCCAA  CACCAATGAA  TGAAATAGGC  CACCAATGAA  TGGAAAAATT     926
||||||||||  ||||||||||  ||||||||||  ||||||||||  ||||||||||  ||||||||||
AATTAATAAA  ACCAGTCCAA  CACCAATGAA  TGAAATAGGC  CACCAATGAA  TGGAAAAATT  122456

ATCTGTCTTC  TCAGTTTCAG  AA                                                 904
||||||||||  ||||||||||  ||
ATCTGTCTTC  TCAGTTTCTG  CA                                              122478
```

Fig. 6D

```
              10         20         30         40         50         60         70         80         90        100
              -          -          -          -          -          -          -          -          -          -
M  MNWHMIISGLIVVVIKVVGMTFFLLYFPQVFGKSNDGFVPTESYGTTSVQNVSQIFGRNDESTMPTRSYGTVCPRNWDFHQGKCFFFSFSESPWKDSMDY
R  MNWHMIISGLIVVVIKVVGMTFFLLYFPQVFGKSNDGFVPTESYGTTSVQNVSQIFGRNDESTMPTRSYGTVCPRNWDFHQGKCFFFSFSESPWKDSMDY
H  MNWHMIISGLIVVVLKVVGMTLFLLYFPQIFNKSNDGFTTTRSYGT--VSQIFGSSSPSPNGFITTRSYGTVCPKDWEFYQARCFFLSTSESSWNESRDF
A  MNWHMIISGLIVVVLKVVGMTLFLLYFPQIFNKSNDGFTTTRSYGT--VSQIFGSSSPSPNGFITTRSYGTVCPKDWEFYQARCFFLSTSESSWNESRDF
C  MNWHMIISGLIVVVLKVVGMTLFLLYFPQIFNKSNDGFTTTRSYGT--V---------------------------CPKDWEFYQARCFFLSTSESSWNESRDF
E  MNWHMIISGLIVVVLKVVGMTLFLLYF--------------------------------------------------CPKDWEFYQARCFFLSTSESSWNESRDF
B  MNWHMIISGLIVVVLKVVGMTLFLLYFPQIFNKSNDGFTTTRSYGT--VSQIFGSSSPSPNGFITTRSYGTVCPKDWEFYQARCFFLSTSESSWNESRDF
D  MNWHMIISGLIVVVLKVVGMTLFLLYFPQIFNKSNDGFTTTRSYGT--V---------------------------CPKDWEFYQARCFFLSTSESSWNESRDF
F  MNWHMIISGLIVVVLKVVGMTLFLLYF--------------------------------------------------CPKDWEFYQARCFFLSTSESSWNESRDF 110        120        130        140        150        160        170        180
              -          -          -          -          -          -          -          -
M  CATQGSTLAIVNTPEKLKFLQDITDAEKYFIGLIYHREEKRWRWINNSVFNGNVTNQDQNFDCVTIGLTKTYDAASCEVSYRWICEMNAK
R  CATQGSTLAIVNTPEKLKFLQDITDAEKYFIGLIYHREEKRWRWINNSVFNGNVTNQDQNFDCVTIGLTKTYDAASCEVSYRWICEMNAK
H  CKGKGSTLAIVNTPEKL-FLQDITDAEKYFIGLIYHREEKRWRWINNSVFNGNVTNQNQNFNCATIGLTKTFDAASCDISYRRICEKNAK
A  CKGKGSTLAIVNTPEKLKFLQDITDAEKYFIGLIYHREEKRWRWINNSVFNGNVTNQNQNFNCATIGLTKTFDAASCDISYRRICEKNAK
C  CKGKGSTLAIVNTPEKLKFLQDITDAEKYFIGLIYHREEKRWRWINNSVFNGNVTNQNQNFNCATIGLTKTFDAASCDISYRRICEKNAK
E  CKGKGSTLAIVNTPEKLKFLQDITDAEKYFIGLVRQPGEKKWRWINNSVFNGNVTNQNQNFNCATIGLTKTFDAASCDISYRRICEKNAK
B  CKGKGSTLAIVNTPEKLKFLQDITDAEKYFIGLVRQPGEKKWRWINNSVFNGNVTNQNQNFNCATIGLTKTFDAASCDISYRRICEKNAK
D  CKGKGSTLAIVNTPEKLKFLQDITDAEKYFIGLIYHREEKRWRWINNSVFNGKYVNMPQFPGDLGLLQKTKPEIAGFTLE
F  CKGKGSTLAIVNTPEKLKFLQDITDAEKYFIGLIYHREEKRWRWINNSVFNGKYVNMPQFPGDLGLLQKTKPEIAGFTLE
```

Fig. 8

```
          10         20         30         40         50         60         70         80         90        100
          |          |          |          |          |          |          |          |          |          |
A  GTGGTCGCGGCCGAGGTGAGACTGTGAAGAAGGAAGAACGTTGCTTGGGCAAAAGGAGCATATTCTCAGGAGACGGGGCCCTGCTGCCACACCAAGCA
B  GTGGTCGCGGCCGAGGTGAGACTGTGAAGAAGGAAGAACGTTGCTTGGGCAAAAGGAGCATATTCTCAGGAGACGGGGCCCTGCTGCCACACCAAGCA
C  GAGACTGTGAAGAAGGAAG----------AACGTTGCTTGGGCAAAAGGAGCATATTCTCAGGAGACGGGGCCCTGCTGCCACACCAAGCA
D  GAGACTGTGAAGAAGGAAG----------AACGTTGCTTGGGCAAAAGGAGCATATTCTCAGGAGACGGGGCCCTGCTGCCACACCAAGCA
E  GAGACTGTGAAGAAGGAAG----------AACGTTGCTTGGGCAAAAGGAGCATATTCTCAGGAGACGGGGCCCTGCTGCCACACCAAGCA
F  GAGACTGTGAAGAAGGAAG----------AACGTTGCTTGGGCAAAAGGAGCATATTCTCAGGAGACGGGGCCCTGCTGCCACACCAAGCA 110        120        130        140        150        160        170        180        190        200
          |          |          |          |          |          |          |          |          |          |
A  TTAGGCCACCAGGAAGAGACCCCCATCTGCAAGCAAGCCTAGCCTTCCAGGAGAGAGAGGCCCCTGCAGCTCCTTCATCATGAACTGCACATGATCATCT
B  TTAGGCCACCAGGAAGAGACCCCCATCTGCAAGCAAGCCTAGCCTTCCAGGAGAGAGAGGCCCCTGCAGCTCCTTCATCATGAACTGCACATGATCATCT
C  TTAGGCCACCAGGAAGAGACCCCCATCTGCAAGCAAGCCTAGCCTTCCAGGAGAGAGAGGCCCCTGCAGCTCCTTCATCATGAACTGCACATGATCATCT
D  TTAGGCCACCAGGAAGAGACCCCCATCTGCAAGCAAGCCTAGCCTTCCAGGAGAGAGAGGCCCCTGCAGCTCCTTCATCATGAACTGCACATGATCATCT
E  TTAGGCCACCAGGAAGAGACCCCCATCTGCAAGCAAGCCTAGCCTTCCAGGAGAGAGAGGCCCCTGCAGCTCCTTCATCATGAACTGCACATGATCATCT
F  TTAGGCCACCAGGAAGAGACCCCCATCTGCAAGCAAGCCTAGCCTTCCAGGAGAGAGAGGCCCCTGCAGCTCCTTCATCATGAACTGCACATGATCATCT 210        220        230        240        250        260        270        280        290        300
          |          |          |          |          |          |          |          |          |          |
A  CTGGGCTTATTGTGGTAGTGTGCTTAAAGTTGTTGGAATGACCTTATTTCCACAGATTTTTAACAAAAGTAACGATGTTTCACCACCAC
B  CTGGGCTTATTGTGGTAGTGTGCTTAAAGTTGTTGGAATGACCTTATTTCCACAGATTTTTAACAAAAGTAACGATGTTTCACCACCAC
C  CTGGGCTTATTGTGGTAGTGTGCTTAAAGTTGTTGGAATGACCTTATTTCCACAGATTTTTAACAAAAGTAACGATGTTTCACCACCAC
D  CTGGGCTTATTGTGGTAGTGTGCTTAAAGTTGTTGGAATGACCTTATTTCCACAGATTTTTAACAAAAGTAACGATGTTTCACCACCAC
E  CTGGGCTTATTGTGGTAGTGTGCTTAAAGTTGTTGGAATGACCTTATTTCTACTTTATT-------------------------------
F  CTGGGCTTATTGTGGTAGTGTGCTTAAAGTTGTTGGAATGACCTTATTTCTACTTTATT-------------------------------
```

Fig. 9A

```
      310        320        330        340        350        360        370        380        390        400
       |          |          |          |          |          |          |          |          |          |
A CAGGAGCTATGAACAGTCTCACAGATTTTGGGAGCAGTCCCCAAGTCCCAAGTCCCAAGGAGCTATTACCACAAGGAGCTATGAACAGTCTGCCCCAAAGAC
B CAGGAGCTATGAACAGTCTCACAGATTTTGGGAGCAGTCCCCAAGTCCCAAGGAGCTTCATTACCACAAGGAGCTATGAACAGTCTGCCCCAAAGAC
C CAGGAGCTATGAACAG----------------------------------------------------------------TCTGCCCCAAAGAC
D CAGGAGCTATGAACAG----------------------------------------------------------------TCTGCCCCAAAGAC
E ----------------------------------------------------------------------------------TCTGCCCCAAAGAC
F ----------------------------------------------------------------------------------TCTGCCCCAAAGAC 410        420        430        440        450        460        470        480        490        500
       |          |          |          |          |          |          |          |          |          |
A TGGGAATTTTATCAAGCAAGATGTTTTTCTTATCCACTTCTGAATCATCTTGGAATGAAAGCAGGACTTTTGCAAAGGAAAAAGGATCCACATTGGCAA
B TGGGAATTTTATCAAGCAAGATGTTTTTCTTATCCACTTCTGAATCATCTTGGAATGAAAGCAGGACTTTTGCAAAGGAAAAAGGATCCACATTGGCAA
C TGGGAATTTTATCAAGCAAGATGTTTTTCTTATCCACTTCTGAATCATCTTGGAATGAAAGCAGGACTTTTGCAAAGGAAAAAGGATCCACATTGGCAA
D TGGGAATTTTATCAAGCAAGATGTTTTTCTTATCCACTTCTGAATCATCTTGGAATGAAAGCAGGACTTTTGCAAAGGAAAAAGGATCCACATTGGCAA
E TGGGAATTTTATCAAGCAAGATGTTTTTCTTATCCACTTCTGAATCATCTTGGAATGAAAGCAGGACTTTTGCAAAGGAAAAAGGATCCACATTGGCAA
F TGGGAATTTTATCAAGCAAGATGTTTTTCTTATCCACTTCTGAATCATCTTGGAATGAAAGCAGGACTTTTGCAAAGGAAAAAGGATCCACATTGGCAA 510        520        530        540        550        560        570        580        590        600
       |          |          |          |          |          |          |          |          |          |
A TTGTCAACACGCCAGAGAAACTGAAGTTTCTTCAGGACATAACTGATGCTGAGAAGTATTTTATTGGCTTAATTTACCATCGTGAAGAGAAAAGGTGGCG
B TTGTCAACACGCCAGAGAAACTGAAGTTTCTTCAGGACATAACTGATGCTGAGAAGTATTTTATTGGCTTAATTTACCATCGTGAAGAGAAAAGGTGGCG
C TTGTCAACACGCCAGAGAAACTGAAGTTTCTTCAGGACATAACTGATGCTGAGAAGTATTTTATTGGCTTAATTTACCATCGTGAAGAGAAAAGGTGGCG
D TTGTCAACACGCCAGAGAAACTGAAGTTTCTTCAGGACATAACTGATGCTGAGAAGTATTTTATTGGCTTAATTTACCATCGTGAAGAGAAAAGGTGGCG
E TTGTCAACACGCCAGAGAAACTGAAGTTTCTTCAGGACATAACTGATGCTGAGAAGTATTTTATTGGCTTAATTTACCATCGTGAAGAGAAAAGGTGGCG
F TTGTCAACACGCCAGAGAAACTGAAGTTTCTTCAGGACATAACTGATGCTGAGAAGTATTTTATTGGCTTAATTTACCATCGTGAAGAGAAAAGGTGGCG
```

Fig. 9B

```
         610        620        630        640        650        660        670        680        690        700
          |          |          |          |          |          |          |          |          |          |
A  TTGGATCAACAACTCTGTGTTCAATGGCAAGTACGTGAACATGCCAATCAGAATTCAGAATTCAGAGAATTCAACTGCCGACCATTGGCCTTCAAAAGACCAAACCTGAGATTGATGCTGCATCA
B  TTGGATCAACAACTCTGTGTTCAATGGCAAGTACGTGAACATGCCAATCAGAATTCAGAATTCAGAGAATTCAACTGCCGACCATTGGCCTTCAAAAGACCAAACCTGAGATTGCTGCTGGG
C  TTGGATCAACAACTCTGTGTTCAATGGCAAGTACGTGAACATGCCAATCAGAATTCAGAATTCAGAGAATTCAACTGCCGACCATTGGCCTTTGCTTCAAAAGACCAAACCTGAGATTGATGCTGCATCA
D  TTGGATCAACAACTCTGTGTTCAATGGCAAGTACGTGAACATGCCAATCAGAATTCAGAATTCAGAGAATTCAACTGCCGACCATTGTTGTCTTGCTTCAAAAGACCAAACCTGAGATTGCTGCTGGG
E  TTGGATCAACAACTCTGTGTTCAATGGCAAGTACGTGAACATGCCAATCAGAATTCAGAATTCAGAGAATGCCGACCATTGGCCTTCAAAAGACATTGATGCTGCATCA
F  TTGGATCAACAACTCTGTGTTCAATGGCAAGTACGTGAACATGCCAATCAGAATTCAGAATTCAGAGAATGCCGACCATTGGCCTTCAAAAGACCAAACCTGAGATTGCTGGG 710        720        730        740        750        760        770        780        790        800
          |          |          |          |          |          |          |          |          |          |
A  TGTGACATCAGCTACCGCAGGATCTCAAACGCTGACACTTGAGAAGAATGCCAAATGATCACAGTTCCCTGTCTTCTCCCTTTCTTGCTCTGTGACAAGAACTATACTTGCAACTCTTTTTGAATCCATACAGG
B  TTCACCCTGGAATAGCTCAAACGCTGACACTTGAGAAGAATGCCAAATGATCACAGTTCCCTGTCTTCTCCCTTTCTTGCTCTGTGACAAGAACTATACTTGCAACTCTTTTTGAATCCATACAGG
C  TGTGACATCAGCTACCGCAGGATCTCAAACGCTGACACTTGAGAAGAATGCCAAATGATCACAGTTCCCTGTCTTCTCCCTTTCTTGCTCTGTGACAAGAACTATACTTGCAACTCTTTTTGAATCCATACAGG
D  TTCACCCTGGAATAGCTCAAACGCTGACACTTGAGAAGAATGCCAAATGATCACAGTTCCCTGTCTTCTCCCTTTCTTGCTCTGTGACAAGAACTATACTTGCAACTCTTTTTGAATCCATACAGG
E  TGTGACATCAGCTACCGCAGGATCTCAAACGCTGACACTTGAGAAGAATGCCAAATGATCACAGTTCCCTGTCTTCTCCCTTTCTTGCTCTGTGACAAGAACTATACTTGCAACTCTTTTTGAATCCATACAGG
F  TTCACCCTGGAATAGCTCAAACGCTGACACTTGAGAAGAATGCCAAATGATCACAGTTCCCTGTCTTCTCCCTTTCTTGCTCTGTGACAAGAACTATACTTGCAACTCTTTTTGAATCCATACAGG 810        820        830        840        850        860        870        880        890        900
          |          |          |          |          |          |          |          |          |          |
A  TCGTCTGGCCAATGATTCTTTACTTACCTATCTGTCTACCAGTAGCGGTCCTTGCCCATTTGGGAAACTGAGCTTCTTTCTTCTGCCACTGGGGACTGG
B  ----------------CCTATCTGTCTACCTATCTGTCTACCAGTAGCGGTCCTTGCCCATTTGGGAAACTGAGCTTCTTTCTTCTGCCACTGGGGACTGG
C  TCGTCTGGCCAATGATTCTTTTACTTACCTATCTGTCTACCAGTAGCGGTCCTTGCCCATTTGGGAAACTGAGCTTCTTTCTTCTGCCACTGGGGACTGG
D  ----------------CCTATCTGTCTATCTGTCTACCAGTAGCGGTCCTTGCCCATTTGGGAAACTGAGCTTCTTTCTTCTGCCACTGGGGACTGG
E  TCGTCTGGCCAATGATTCTTTTACTTACCTATCTGTCTACCAGTAGCGGTCCTTGCCCATTTGGGAAACTGAGCTTCTTTCTTCTGCCACTGGGGACTGG
F  ----------------CCTATCTGTCTACCAGTAGCGGTCCTTGCCCATTTGGGAAACTGAGCTTCTTTCTTCTGCCACTGGGGACTGG
```

Fig. 9C

```
       910        920        930        940        950        960        970        980        990       1000
        |          |          |          |          |          |          |          |          |          |
A  ATGCTAGCCATCTCCAGGAGACAGGATCAGTTTTACGGAAACAACTCAGTTAGTATAGAGAGATGAGGTCCGCTTCTGTAGTACTGAGCATTTCTGACTGAT
B  ATGCTAGCCATCTCCAGGAGACAGGATCAGTTTTACGGAAACAACTCAGTTAGTATAGAGATGAGGTCCGCTTCTGTAGTACTGAGCATTTCTGACTGAT
C  ATGCTAGCCATCTCCAGGAGACAGGATCAGTTTTACGGAAACAACTCAGTTAGTATAGAGATGAGGTCCGCTTCTGTAGTACTGAGCATTTCTGACTGAT
D  ATGCTAGCCATCTCCAGGAGACAGGATCAGTTTTACGGAAACAACTCAGTTAGTATAGAGATGAGGTCCGCTTCTGTAGTACTGAGCATTTCTGACTGAT
E  ATGCTAGCCATCTCCAGGAGACAGGATCAGTTTTACGGAAACAACTCAGTTAGTATAGAGATGAGGTCCGCTTCTGTAGTACTGAGCATTTCTGACTGAT
F  ATGCTAGCCATCTCCAGGAGACAGGATCAGTTTTACGGAAACAACTCAGTTAGTATAGAGATGAGGTCCGCTTCTGTAGTACTGAGCATTTCTGACTGAT 1010       1020       1030       1040       1050       1060       1070       1080       1090       1100
        |          |          |          |          |          |          |          |          |          |
A  CAAAAAGGCCTAGTCTGTTGACAGGGTTTGTTTTATTTTAGCCTCAGAGTATACCATACTACTAGGGAGTAACTGTAGAGTGAGAAATTATAAACATTAT
B  CAAAAAGGCCTAGTCTGTTGACAGGGTTTGTTTTATTTTAGCCTCAGAGTATACCATACTACTAGGGAGTAACTGTAGAGTGAGAAATTATAAACATTAT
C  CAAAAAGGCCTAGTCTGTTGACAGGGTTTGTTTTATTTTAGCCTCAGAGTATACCATACTACTAGGGAGTAACTGTAGAGTGAGAAATTATAAACATTAT
D  CAAAAAGGCCTAGTCTGTTGACAGGGTTTGTTTTATTTTAGCCTCAGAGTATACCATACTACTAGGGAGTAACTGTAGAGTGAGAAATTATAAACATTAT
E  CAAAAAGGCCTAGTCTGTTGACAGGGTTTGTTTTATTTTAGCCTCAGAGTATACCATACTACTAGGGAGTAACTGTAGAGTGAGAAATTATAAACATTAT
F  CAAAAAGGCCTAGTCTGTTGACAGGGTTTGTTTTATTTTAGCCTCAGAGTATACCATACTACTAGGGAGTAACTGTAGAGTGAGAAATTATAAACATTAT 1110       1120       1130       1140       1150       1160       1170       1180       1190       1200
        |          |          |          |          |          |          |          |          |          |
A  TTAGGGATTACCATGGTGGAAGAGGGATAAACATAGGTCCTGTGACTTCGTCTCTGTTCTCTTCAAGGGAACCCATTCACATGCCCCTCCTAACTCCACAAG
B  TTAGGGATTACCATGGTGGAAGAGGGATAAACATAGGTCCTGTGACTTCGTCTCTGTTCTCTTCAAGGGAACCCATTCACATGCCCCTCCTAACTCCACAAG
C  TTAGGGATTACCATGGTGGAAGAGGGATAAACATAGGTCCTGTGACTTCGTCTCTGTTCTCTTCAAGGGAACCCATTCACATGCCCCTCCTAACTCCACAAG
D  TTAGGGATTACCATGGTGGAAGAGGGATAAACATAGGTCCTGTGACTTCGTCTCTGTTCTCTTCAAGGGAACCCATTCACATGCCCCTCCTAACTCCACAAG
E  TTAGGGATTACCATGGTGGAAGAGGGATAAACATAGGTCCTGTGACTTCGTCTCTGTTCTCTTCAAGGGAACCCATTCACATGCCCCTCCTAACTCCACAAG
F  TTAGGGATTACCATGGTGGAAGAGGGATAAACATAGGTCCTGTGACTTCGTCTCTGTTCTCTTCAAGGGAACCCATTCACATGCCCCTCCTAACTCCACAAG
```

Fig. 9D

```
        1210       1220       1230       1240       1250       1260       1270       1280       1290       1300
         |          |          |          |          |          |          |          |          |          |
A  CGAGGGTAGCAGAGGCTCTCCTCAGTCTGAACTAAGGCTTGGCCTTGGGGAGGGCTCCTAGTGCTGAGCTTGGAGCACGGAGACAGCAGCAGCATTGTTTAT
B  CGAGGGTAGCAGAGGCTCTCCTCAGTCTGAACTAAGGCTTGGCCTTGGGGAGGGCTCCTAGTGCTGAGCTTGGAGCAGCAGCAGCAGCAGCATTGTTTAT
C  CGAGGGTAGCAGAGGCTCTCCTCAGTCTGAACTAAGGCTTGGCCTTGGGGAGGGCTCCTAGTGCTGAGCTTGGAGCAGCAGCAGCAGCAGCATTGTTTAT
D  CGAGGGTAGCAGAGGCTCTCCTTCAGTCTGAACTAAGGCTTGGCCTTGGGGAGGGCTCCTAGTGCTGAGCTTGGAGCACGGAGACAGCAGCATTGTTTAT
E  CGAGGGTAGCAGAGGCTCTCCTCAGTCTGAACTAAGGCTTGGCCTTGGGGAGGGCTCCTAGTGCTGAGCTTGGAGCACGGAGACAGCAGCATTGTTTAT
F  CGAGGGTAGCAGAGGCTCTCCTCAGTCTGAACTAAGGCTTGGCCTTGGGGAGGGCTCCTAGTGCTGAGCTTGGAGCACGGAGACAGCAGCATTGTTTAT 1310       1320       1330       1340       1350       1360       1370       1380       1390       1400
         |          |          |          |          |          |          |          |          |          |
A  GGGAATGGAGAGAGGTCTGGGCAGGATAGGAACCTTCTTGGAGACCCCTTTGAAGAAAACCAGGGAGCCAAACACAGCCAGCCAAACACACTAGATTTCTGTTCT
B  GGGAATGGAGAGAGGTCTGGGCAGGATAGGAACCTTCTTGGAGACCCCTTTGAAGAAAACCAGGGAGCCAAACACAGCCAGCCAAACACACTAGATTTCTGTTCT
C  GGGAATGGAGAGAGGTCTGGGCAGGATAGGAACCTTCTTGGAGACCCCTTTGAAGAAAACCAGGGAGCCAAACACAGCCAGCCAAACACACTAGATTTCTGTTCT
D  GGGAATGGAGAGAGGTCTGGGCAGGATAGGAACCTTCTTGGAGACCCCTTTGAAGAAAACCAGGGAGCCAAGGAGCCAAACACACTAGATTTCTGTTCT
E  GGGAATGGAGAGAGGTCTGGGCAGGATAGGAACCTTCTTGGAGACCCCTTTGAAGAAAACCAGGGAGCCAAGGAGCCAAACACACTAGATTTCTGTTCT
F  GGGAATGGAGAGAGGTCTGGGCAGGATAGGAACCTTCTTGGAGACCCCTTTGAAGAAAACCAGGGAGCCAAGGAGCCAAACACACTAGATTTCTGTTCT 1410       1420       1430       1440       1450       1460       1470       1480       1490       1500
         |          |          |          |          |          |          |          |          |          |
A  TCAGCAAAGCCCTGAAGAGACACTTAAGCTAAAAATTCCCTTGTCATATTTCTGAAACTCCATTATAACATATGTAACTCCTTTGTAACCAAAATTTAGG
B  TCAGCAAAGCCCTGAAGAGACACTTAAGCTAAAAATTCCCTTGTCATATTTCTGAAACTCCATTATAACATATGTAACTCCTTTGTAACCAAAATTTAGG
C  TCAGCAAAGCCCTGAAGAGACACTTAAGCTAAAAATTCCCTTGTCATATTTCTGAAACTCCATTATAACATATGTAACTCCTTTGTAACCAAAATTTAGG
D  TCAGCAAAGCCCTGAAGAGACACTTAAGCTAAAAATTCCCTTGTCATATTTCTGAAACTCCATTATAACATATGTAACTCCTTTGTAACCAAAATTTAGG
E  TCAGCAAAGCCCTGAAGAGACACTTAAGCTAAAAATTCCCTTGTCATATTTCTGAAACTCCATTATAACATATGTAACTCCTTTGTAACCAAAATTTAGG
F  TCAGCAAAGCCCTGAAGAGACACTTAAGCTAAAAATTCCCTTGTCATATTTCTGAAACTCCATTATAACATATGTAACTCCTTTGTAACCAAAATTTAGG
```

Fig. 9E

```
          1510       1520       1530       1540       1550       1560       1570       1580       1590       1600
           |          |          |          |          |          |          |          |          |          |
A  TAAGCAGGCTTCCTTTGCTCTGAAGGTTTTGAGTACCTGGCTGCTATTTGTTGAGTATTTTAAAAATTTGGATAGTCTCTTAGCCAACAATAATCACAAT
B  TAAGCAGGCTTCCTTTGCTCTGAAGGTTTTGAGTACCTGGCTGCTATTTGTTGAGTATTTTAAAAATTTGGATAGTCTCTTAGCCAACAATAATCACAAT
C  TAAGCAGGCTTCCTTTGCTCTGAAGGTTTTGAGTACCTGGCTGCTATTTGTTGAGTATTTTAAAAATTTGGATAGTCTCTTAGCCAACAATAATCACAAT
D  TAAGCAGGCTTCCTTTGCTCTGAAGGTTTTGAGTACCTGGCTGCTATTTGTTGAGTATTTTAAAAATTTGGATAGTCTCTTAGCCAACAATAATCACAAT
E  TAAGCAGGCTTCCTTTGCTCTGAAGGTTTTGAGTACCTGGCTGCTATTTGTTGAGTATTTTAAAAATTTGGATAGTCTCTTAGCCAACAATAATCACAAT
F  TAAGCAGGCTTCCTTTGCTCTGAAGGTTTTGAGTACCTGGCTGCTATTTGTTGAGTATTTTAAAAATTTGGATAGTCTCTTAGCCAACAATAATCACAAT 1610       1620       1630       1640       1650       1660       1670       1680       1690       1700
           |          |          |          |          |          |          |          |          |          |
A  ATATTCATCCCTTCAGTTCTGGAGAAAGCCTGATACCAGGCACAGCCTGACCCCAAGGAGCCTGGCACTGATTGGCATCACATTGATCTAGAACTGG
B  ATATTCATCCCTTCAGTTCTGGAGAAAGCCTGATACCAGGCACAGCCTGACCCCAAGGAGCCTGGCACTGATTGGCATCACATTGATCTAGAACTGG
C  ATATTCATCCCTTCAGTTCTGGAGAAAGCCTGATACCAGGCACAGCCTGACCCCAAGGAGCCTGGCACTGATTGGCATCACATTGATCTAGAACTGG
D  ATATTCATCCCTTCAGTTCTGGAGAAAGCCTGATACCAGGCACAGCCTGACCCCAAGGAGCCTGGCACTGATTGGCATCACATTGATCTAGAACTGG
E  ATATTCATCCCTTCAGTTCTGGAGAAAGCCTGATACCAGGCACAGCCTGACCCCAAGGAGCCTGGCACTGATTGGCATCACATTGATCTAGAACTGG
F  ATATTCATCCCTTCAGTTCTGGAGAAAGCCTGATACCAGGCACAGCCTGACCCCAAGGAGCCTGGCACTGATTGGCATCACATTGATCTAGAACTGG 1710       1720       1730       1740       1750       1760       1770       1780       1790       1800
           |          |          |          |          |          |          |          |          |          |
A  TCCAGCCGCCGAAGAGTAGGAAAAGAGAAGGGCTGCTCAGGGAAAACATTGGCTCAGGGAAACATTGGCTGGGGGCACGGAATAAGCACATAGTAAAAAGGGAACATCAGGGTCAAA
B  TCCAGCCGCCGAAGAGTAGGAAAAGAGAAGGGCTGCTCAGGGAAAACATTGGCTCAGGGAAACATTGGCTGGGGGCACGGAATAAGCACATAGTAAAAAGGGAACATCAGGGTCAAA
C  TCCAGCCGCCGAAGAGTAGGAAAAGAGAAGGGCTGCTCAGGGAAAACATTGGCTCAGGGAAACATTGGCTGGGGGCACGGAATAAGCACATAGTAAAAAGGGAACATCAGGGTCAAA
D  TCCAGCCGCCGAAGAGTAGGAAAAGAGAAGGGCTGCTCAGGGAAAACATTGGCTCAGGGAAACATTGGCTGGGGGCACGGAATAAGCACATAGTAAAAAGGGAACATCAGGGTCAAA
E  TCCAGCCGCCGAAGAGTAGGAAAAGAGAAGGGCTGCTCAGGGAAAACATTGGCTCAGGGAAACATTGGCTGGGGGCACGGAATAAGCACATAGTAAAAAGGGAACATCAGGGTCAAA
F  TCCAGCCGCCGAAGAGTAGGAAAAGAGAAGGGCTGCTCAGGGAAAACATTGGCTCAGGGAAACATTGGCTGGGGGCACGGAATAAGCACATAGTAAAAAGGGAACATCAGGGTCAAA
```

Fig. 9F

```
     1810       1820       1830       1840       1850       1860       1870       1880       1890       1900
      |          |          |          |          |          |          |          |          |          |
A TGGAAATCACCTGAGACAGGAAACAGGGAGTTCATTTGGCCACACTGGAAGAAAAGGAAGAAGAGGAAGACAAGTCTTGGAGTACCCTGGCTGTTCTCC
B TGGAAATCACCTGAGACAGGAAACAGGGAGTTCATTTGGCCACACTGGAAGAAAAGGAAGAAGAGGAAGACAAGTCTTGGAGTACCCTGGCTGTTCTCC
C TGGAAATCACCTGAGACAGGAAACAGGGAGTTCATTTGGCCACACTGGAAGAAAAGGAAGAAGAGGAAGACAAGTCTTGGAGTACCCTGGCTGTTCTCC
D TGGAAATCACCTGAGACAGGAAACAGGGAGTTCATTTGGCCACACTGGAAGAAAAGGAAGAAGAGGAAGACAAGTCTTGGAGTACCCTGGCTGTTCTCC
E TGGAAATCACCTGAGACAGGAAACAGGGAGTTCATTTGGCCACACTGGAAGAAAAGGAAGAAGAGGAAGACAAGTCTTGGAGTACCCTGGCTGTTCTCC
F TGGAAATCACCTGAGACAGGAAACAGGGAGTTCATTTGGCCACACTGGAAGAAAAGGAAGAAGAGGAAGACAAGTCTTGGAGTACCCTGGCTGTTCTCC 1910       1920       1930       1940       1950       1960       1970       1980       1990       2000
      |          |          |          |          |          |          |          |          |          |
A ACACTCACAAGACATCAGCTATACTCTGCTTGGTGTCATAAGAAAAGAGAAAAGAAAAGAGATGCCTTTTGTGTTTGTTTTGAGTAAGAATAATTAAACCATAAGGAAGAC
B ACACTCACAAGACATCAGCTATACTCTGCTTGGTGTCATAAGAAAAGAGAAAAGAAAAGAGATGCCTTTTGTGTTTGTTTTGAGTAAGAATAATTAAACCATAAGGAAGAC
C ACACTCACAAGACATCAGCTATACTCTGCTTGGTGTCATAAGAAAAGAGAAAAGAAAAGAGATGCCTTTTGTGTTTGTTTTGAGTAAGAATAATTAAACCATAAGGAAGAC
D ACACTCACAAGACATCAGCTATACTCTGCTTGGTGTCATAAGAAAAGAGAAAAGAAAAGAGATGCCTTTTGTGTTTGTTTTGAGTAAGAATAATTAAACCATAAGGAAGAC
E ACACTCACAAGACATCAGCTATACTCTGCTTGGTGTCATAAGAAAAGAGAAAAGAAAAGAGATGCCTTTTGTGTTTGTTTTGAGTAAGAATAATTAAACCATAAGGAAGAC
F ACACTCACAAGACATCAGCTATACTCTGCTTGGTGTCATAAGAAAAGAGAAAAGAAAAGAGATGCCTTTTGTGTTTGTTTTGAGTAAGAATAATTAAACCATAAGGAAGAC 2010       2020       2030       2040       2050       2060       2070       2080       2090       2100
      |          |          |          |          |          |          |          |          |          |
A CATGTATAAAACTGATGGAAATAATAGTCACCAAAGTACAGCACATACCATTTGTGTCTAATAACAATGTAGCACAGTAATGACTGTACATGTCATTGT
B CATGTATAAAACTGATGGAAATAATAGTCACCAAAGTACAGCACATACCATTTGTGTCTAATAACAATGTAGCACAGTAATGACTGTACATGTCATTGT
C CATGTATAAAACTGATGGAAATAATAGTCACCAAAGTACAGCACATACCATTTGTGTCTAATAACAATGTAGCACAGTAATGACTGTACATGTCATTGT
D CATGTATAAAACTGATGGAAATAATAGTCACCAAAGTACAGCACATACCATTTGTGTCTAATAACAATGTAGCACAGTAATGACTGTACATGTCATTGT
E CATGTATAAAACTGATGGAAATAATAGTCACCAAAGTACAGCACATACCATTTGTGTCTAATAACAATGTAGCACAGTAATGACTGTACATGTCATTGT
F CATGTATAAAACTGATGGAAATAATAGTCACCAAAGTACAGCACATACCATTTGTGTCTAATAACAATGTAGCACAGTAATGACTGTACATGTCATTGT
```

Fig. 9G

```
        2110       2120       2130       2140       2150       2160       2170       2180       2190       2200
          |          |          |          |          |          |          |          |          |          |
A  ATGTATACCAAACAAGATTGTTGTAAATCATATTTTTATTACAACACTAAGTTCTGCATTCCTAGGTTTCATCATTTTTGGCTCCTTAGCATG
B  ATGTATACCAAACAAGATTGTTGTAAATCATATTTTTATTACAACACTAAGTTCTGCATTCCTAGGTTTCATCATTTTTGGCTCCTTAGCATG
C  ATGTATACCAAACAAGATTGTTGTAAATCATATTTTTATTACAACACTAAGTTCTGCTTCTGCATTCCTAGGTTTCATCATTTTTGGCTCCTCCTTAGCATG
D  ATGTATACCAAACAAGATTGTTGTAAATCATATTTTTATTACAACACTAAGTTCTGCTTCTGCATTCCTAGGTTTCATCATTTTTGGCTCCTCCTTAGCATG
E  ATGTATACCAAACAAGATTGTTGTAAATCATATTTTTATTACAACACTAAGTTCTGCATTCCTAGGTTTCATCATTTTTGGCTCCTTAGCATG
F  ATGTATACCAAACAAGATTGTTGTAAATCATATTTTTATTACAACACTAAGTTCTGCATTCCTAGGTTTCATCATTTTTGGCTCCTTAGCATG 2210       2220       2230       2240       2250       2260       2270       2280       2290       2300
          |          |          |          |          |          |          |          |          |          |
A  GCCACTTACAATTTTTAACATGAGATAACACATCAGGTGTCAGAACTTGCTTGAAGGGAATTACCAGAAGTAATTGTGTTGAGATGGGGTGGAAATT
B  GCCACTTACAATTTTTAACATGAGATAACACATCAGGTGTCAGAACTTGCTTGAAGGGAATTACCAGAAGTAATTGTGTTGAGATGGGGTGGAAATT
C  GCCACTTACAATTTTTAACATGAGATAACACATCAGGTGTCAGAACTTGCTTGAAGGGAATTACCAGAAGTAATTGTGTTGAGATGGGGTGGAAATT
D  GCCACTTACAATTTTTAACATGAGATAACACATCAGGTGTCAGAACTTGCTTGAAGGGAATTACCAGAAGTAATTGTGTTGAGATGGGGTGGAAATT
E  GCCACTTACAATTTTTAACATGAGATAACACATCAGGTGTCAGAACTTGCTTGAAGGGAATTACCAGAAGTAATTGTGTTGAGATGGGGTGGAAATT
F  GCCACTTACAATTTTTAACATGAGATAACACATCAGGTGTCAGAACTTGCTTGAAGGGAATTACCAGAAGTAATTGTGTTGAGATGGGGTGGAAATT 2310       2320       2330       2340       2350       2360       2370       2380       2390       2400
          |          |          |          |          |          |          |          |          |          |
A  GGAATTATATTAGTAGCCGGTGGAGATGGAGATACAAGTTCTCTGACTGTGTTGGGAAAGGATAAGTGCTACCGTTGAGAAGGGAAGAAAGGCTGAGTCTAGGTGG
B  GGAATTATATTAGTAGCCGGTGGAGATGGAGATACAAGTTCTCTGACTGTGTTGGGAAAGGATAAGTGCTACCGTTGAGAAGGGAAGAAAGGCTGAGTCTAGGTGG
C  GGAATTATATTAGTAGCCGGTGGAGATGGAGATACAAGTTCTCTGACTGTGTTGGGAAAGGATAAGTGCTACCGTTGAGAAGGGAAGAAAGGCTGAGTCTAGGTGG
D  GGAATTATATTAGTAGCCGGTGGAGATGGAGATACAAGTTCTCTGACTGTGTTGGGAAAGGATAAGTGCTACCGTTGAGAAGGGAAGAAAGGCTGAGTCTAGGTGG
E  GGAATTATATTAGTAGCCGGTGGAGATGGAGATACAAGTTCTCTGACTGTGTTGGGAAAGGATAAGTGCTACCGTTGAGAAGGGAAGAAAGGCTGAGTCTAGGTGG
F  GGAATTATATTAGTAGCCGGTGGAGATGGAGATACAAGTTCTCTGACTGTGTTGGGAAAGGATAAGTGCTACCGTTGAGAAGGGAAGAAAGGCTGAGTCTAGGTGG
```

Fig. 9H

```
        2410       2420       2430       2440       2450       2460       2470       2480       2490       2500
          |          |          |          |          |          |          |          |          |          |
A  AGAAAAATATCAACGAACTCTAGCCAAAGGCAAGCCCCAGAACTCAGACAACAGAAAGGAAATCCTAATCCTTCTGTTTTGAGAAGAGAGAACTGTAGT
B  AGAAAAATATCAACGAACTCTAGCCAAAGGCAAGCCCCAGAACTCAGACAACAGAAAGGAAATCCTAATCCTTCTGTTTTGAGAAGAGAGAACTGTAGT
C  AGAAAAATATCAACGAACTCTAGCCAAAGGCAAGCCCCAGAACTCAGACAACAGAAAGGAAATCCTAATCCTTCTGTTTTGAGAAGAGAGAACTGTAGT
D  AGAAAAATATCAACGAACTCTAGCCAAAGGCAAGCCCCAGAACTCAGACAACAGAAAGGAAATCCTAATCCTTCTGTTTTGAGAAGAGAGAACTGTAGT
E  AGAAAAATATCAACGAACTCTAGCCAAAGGCAAGCCCCAGAACTCAGACAACAGAAAGGAAATCCTAATCCTTCTGTTTTGAGAAGAGAGAACTGTAGT
F  AGAAAAATATCAACGAACTCTAGCCAAAGGCAAGCCCCAGAACTCAGACAACAGAAAGGAAATCCTAATCCTTCTGTTTTGAGAAGAGAGAACTGTAGT 2510       2520       2530       2540       2550       2560       2570       2580       2590       2600
          |          |          |          |          |          |          |          |          |          |
A  TGCTTCACTTCCTATTTCATGACAGAATAACTGCAAACTTTTAAGATCAGGAAATGTAGACATCTAGTGATTTCTTAGTAGACAGTTTAATTTCCCCCA
B  TGCTTCACTTCCTATTTCATGACAGAATAACTGCAAACTTTTAAGATCAGGAAATGTAGACATCTAGTGATTTCTTAGTAGACAGTTTAATTTCCCCCA
C  TGCTTCACTTCCTATTTCATGACAGAATAACTGCAAACTTTTAAGATCAGGAAATGTAGACATCTAGTGATTTCTTAGTAGACAGTTTAATTTCCCCCA
D  TGCTTCACTTCCTATTTCATGACAGAATAACTGCAAACTTTTAAGATCAGGAAATGTAGACATCTAGTGATTTCTTAGTAGACAGTTTAATTTCCCCCA
E  TGCTTCACTTCCTATTTCATGACAGAATAACTGCAAACTTTTAAGATCAGGAAATGTAGACATCTAGTGATTTCTTAGTAGACAGTTTAATTTCCCCCA
F  TGCTTCACTTCCTATTTCATGACAGAATAACTGCAAACTTTTAAGATCAGGAAATGTAGACATCTAGTGATTTCTTAGTAGACAGTTTAATTTCCCCCA 2610       2620       2630       2640       2650       2660       2670       2680       2690       2700
          |          |          |          |          |          |          |          |          |          |
A  AGATTAGGAGACACTTCTGTGCAGGTTCAGTTCTAAAAGGAGCCCAATGGCCTGGGGTGGGAGTGGGAGTAGGAGATAGGAATATGTGGATTTGTTTAAGTTCA
B  AGATTAGGAGACACTTCTGTGCAGGTTCAGTTCTAAAAGGAGCCCAATGGCCTGGGGTGGGAGTGGGAGTAGGAGATAGGAATATGTGGATTTGTTTAAGTTCA
C  AGATTAGGAGACACTTCTGTGCAGGTTCAGTTCTAAAAGGAGCCCAATGGCCTGGGGTGGGAGTGGGAGTAGGAGATAGGAATATGTGGATTTGTTTAAGTTCA
D  AGATTAGGAGACACTTCTGTGCAGGTTCAGTTCTAAAAGGAGCCCAATGGCCTGGGGTGGGAGTGGGAGTAGGAGATAGGAATATGTGGATTTGTTTAAGTTCA
E  AGATTAGGAGACACTTCTGTGCAGGTTCAGTTCTAAAAGGAGCCCAATGGCCTGGGGTGGGAGTGGGAGTAGGAGATAGGAATATGTGGATTTGTTTAAGTTCA
F  AGATTAGGAGACACTTCTGTGCAGGTTCAGTTCTAAAAGGAGCCCAATGGCCTGGGGTGGGAGTGGGAGTAGGAGATAGGAATATGTGGATTTGTTTAAGTTCA
```

Fig. 9I

```
        2710       2720       2730       2740       2750       2760       2770       2780       2790       2800
         |          |          |          |          |          |          |          |          |          |
A TCATTGGGAGAGTTCCTGATCCTTGCAAGCTTAGATAAATGTGATCTTTATTAGATAGCAGTGGCATGCTTTAAAAAAAAAAGGCAATGAAAAATTTAG
B TCATTGGGAGAGTTCCTGATCCTTGCAAGCTTAGATAAATGTGATCTTTATTAGATAGCAGTGGCATGCTTTAAAAAAAAAAGGCAATGAAAAATTTAG
C TCATTGGGAGAGTTCCTGATCCTTGCAAGCTTAGATAAATGTGATCTTTATTAGATAGCAGTGGCATGCTTTAAAAAAAAAAGGCAATGAAAAATTTAG
D TCATTGGGAGAGTTCCTGATCCTTGCAAGCTTAGATAAATGTGATCTTTATTAGATAGCAGTGGCATGCTTTAAAAAAAAAAGGCAATGAAAAATTTAG
E TCATTGGGAGAGTTCCTGATCCTTGCAAGCTTAGATAAATGTGATCTTTATTAGATAGCAGTGGCATGCTTTAAAAAAAAAAGGCAATGAAAAATTTAG
F TCATTGGGAGAGTTCCTGATCCTTGCAAGCTTAGATAAATGTGATCTTTATTAGATAGCAGTGGCATGCTTTAAAAAAAAAAGGCAATGAAAAATTTAG 2810       2820       2830       2840       2850       2860       2870       2880       2890       2900
         |          |          |          |          |          |          |          |          |          |
A CAAGCCACTGAATTTGAGTTTTCACTTTGTTTCTAATATGCTGTGAATCAGTACAGTTTCTTACCCTTCTTGGTCTTAATTCCTTACTGATAAAA
B CAAGCCACTGAATTTGAGTTTTCACTTTGTTTCTAATATGCTGTGAATCAGTACAGTTTCTTACCCTTCTTGGTCTTAATTCCTTACTGATAAAA
C CAAGCCACTGAATTTGAGTTTTCACTTTGTTTCTAATATGCTGTGAATCAGTACAGTTTCTTACCCTTCTTGGTCTTAATTCCTTACTGATAAAA
D CAAGCCACTGAATTTGAGTTTTCACTTTGTTTCTAATATGCTGTGAATCAGTACAGTTTCTTACCCTTCTTGGTCTTAATTCCTTACTGATAAAA
E CAAGCCACTGAATTTGAGTTTTCACTTTGTTTCTAATATGCTGTGAATCAGTACAGTTTCTTACCCTTCTTGGTCTTAATTCCTTACTGATAAAA
F CAAGCCACTGAATTTGAGTTTTCACTTTGTTTCTAATATGCTGTGAATCAGTACAGTTTCTTACCCTTCTTGGTCTTAATTCCTTACTGATAAAA 2910       2920       2930       2940       2950       2960       2970       2980       2990       3000
         |          |          |          |          |          |          |          |          |          |
A TGGGTAGTAATACCTATCTCAAAAAATTATTGCACATATTAAATAACATTCCTCTATGTATCTCAATGGCATTAGACATTAGGAGAAGCATTTGTGA
B TGGGTAGTAATACCTATCTCAAAAAATTATTGCACATATTAAATAACATTCCTCTATGTATCTCAATGGCATTAGACATTAGGAGAAGCATTTGTGA
C TGGGTAGTAATACCTATCTCAAAAAATTATTGCACATATTAAATAACATTCCTCTATGTATCTCAATGGCATTAGACATTAGGAGAAGCATTTGTGA
D TGGGTAGTAATACCTATCTCAAAAAATTATTGCACATATTAAATAACATTCCTCTATGTATCTCAATGGCATTAGACATTAGGAGAAGCATTTGTGA
E TGGGTAGTAATACCTATCTCAAAAAATTATTGCACATATTAAATAACATTCCTCTATGTATCTCAATGGCATTAGACATTAGGAGAAGCATTTGTGA
F TGGGTAGTAATACCTATCTCAAAAAATTATTGCACATATTAAATAACATTCCTCTATGTATCTCAATGGCATTAGACATTAGGAGAAGCATTTGTGA
```

Fig. 9J

```
        3010       3020       3030       3040       3050       3060       3070       3080       3090       3100
          |          |          |          |          |          |          |          |          |          |
A GGATTTGAAGTTGAGATCTTCATCCAAGAAGTAGCTTTTCAATTTGCTAGAAGCTTAATGTAGGCAAGCCACTTCATTTTCAGAACTTGTTTACTCATT
B GGATTTGAAGTTGAGATCTTCATCCAAGAAGTAGCTTTTCAATTTGCTAGAAGCTTAATGTAGGCAAGCCACTTCATTTTCAGAACTTGTTTACTCATT
C GGATTTGAAGTTGAGATCTTCATCCAAGAAGTAGCTTTTCAATTTGCTAGAAGCTTAATGTAGGCAAGCCACTTCATTTTCAGAACTTGTTTACTCATT
D GGATTTGAAGTTGAGATCTTCATCCAAGAAGTAGCTTTTCAATTTGCTAGAAGCTTAATGTAGGCAAGCCACTTCATTTTCAGAACTTGTTTACTCATT
E GGATTTGAAGTTGAGATCTTCATCCAAGAAGTAGCTTTTCAATTTGCTAGAAGCTTAATGTAGGCAAGCCACTTCATTTTCAGAACTTGTTTACTCATT
F GGATTTGAAGTTGAGATCTTCATCCAAGAAGTAGCTTTTCAATTTGCTAGAAGCTTAATGTAGGCAAGCCACTTCATTTTCAGAACTTGTTTACTCATT 3110       3120       3130       3140       3150       3160       3170       3180       3190       3200
          |          |          |          |          |          |          |          |          |          |
A TATAATATGGGAATAAAAATTTGTGCAAGTCAGAGAAGGGTGCCTTAAAAATGTTGTGCCAAGCCACATGAGATCAAAGACACACTTTTCATGACCTCA
B TATAATATGGGAATAAAAATTTGTGCAAGTCAGAGAAGGGTGCCTTAAAAATGTTGTGCCAAGCCACATGAGATCAAAGACACACTTTTCATGACCTCA
C TATAATATGGGAATAAAAATTTGTGCAAGTCAGAGAAGGGTGCCTTAAAAATGTTGTGCCAAGCCACATGAGATCAAAGACACACTTTTCATGACCTCA
D TATAATATGGGAATAAAAATTTGTGCAAGTCAGAGAAGGGTGCCTTAAAAATGTTGTGCCAAGCCACATGAGATCAAAGACACACTTTTCATGACCTCA
E TATAATATGGGAATAAAAATTTGTGCAAGTCAGAGAAGGGTGCCTTAAAAATGTTGTGCCAAGCCACATGAGATCAAAGACACACTTTTCATGACCTCA
F TATAATATGGGAATAAAAATTTGTGCAAGTCAGAGAAGGGTGCCTTAAAAATGTTGTGCCAAGCCACATGAGATCAAAGACACACTTTTCATGACCTCA 3210       3220       3230       3240       3250       3260       3270       3280       3290       3300
          |          |          |          |          |          |          |          |          |          |
A AATGTGGGCCCAGCCTAGGTCAGCCAACCCCCATCCCAACCCTTAGACTCACGAACAAATCCACCTGAGATCAGCAGAGCCACCCTAGATCAGCTGAAACT
B AATGTGGGCCCAGCCTAGGTCAGCCAACCCCCATCCCAACCCTTAGACTCACGAACAAATCCACCTGAGATCAGCAGAGCCACCCTAGATCAGCTGAAACT
C AATGTGGGCCCAGCCTAGGTCAGCCAACCCCCATCCCAACCCTTAGACTCACGAACAAATCCACCTGAGATCAGCAGAGCCACCCTAGATCAGCTGAAACT
D AATGTGGGCCCAGCCTAGGTCAGCCAACCCCCATCCCAACCCTTAGACTCACGAACAAATCCACCTGAGATCAGCAGAGCCACCCTAGATCAGCTGAAACT
E AATGTGGGCCCAGCCTAGGTCAGCCAACCCCCATCCCAACCCTTAGACTCACGAACAAATCCACCTGAGATCAGCAGAGCCACCCTAGATCAGCTGAAACT
F AATGTGGGCCCAGCCTAGGTCAGCCAACCCCCATCCCAACCCTTAGACTCACGAACAAATCCACCTGAGATCAGCAGAGCCACCCTAGATCAGCTGAAACT
```

Fig. 9K

```
       3310       3320       3330       3340       3350       3360       3370       3380       3390       3400
         |          |          |          |          |          |          |          |          |          |
A CTAAGCACAAAAATAAAAACTTATCACTGTAAAAAAAAAAAAAAAAAAGTCTCTCGTATAGCAAAAATCTAACTGATGCAATCTCCATCTGGCCTTC
B CTAAGCACAAAAATAAAAACTTATCACTGTAAAAAAAAAAAAAAAAAAGTCTCTCGTATAGCAAAAATCTAACTGATGCAATCTCCATCTGGCCTTC
C CTAAGCACAAAAATAAAAACTTATCACTGTAAAAAAAAAAAAAAAAAAGTCTCTCGTATAGCAAAAATCTAACTGATGCAATCTCCATCTGGCCTTC
D CTAAGCACAAAAATAAAAACTTATCACTGTAAAAAAAAAAAAAAAAAAGTCTCTCGTATAGCAAAAATCTAACTGATGCAATCTCCATCTGGCCTTC
E CTAAGCACAAAAATAAAAACTTATCACTGTAAAAAAAAAAAAAAAAAAGTCTCTCGTATAGCAAAAATCTAACTGATGCAATCTCCATCTGGCCTTC
F CTAAGCACAAAAATAAAAACTTATCACTGTAAAAAAAAAAAAAAAAAAGTCTCTCGTATAGCAAAAATCTAACTGATGCAATCTCCATCTGGCCTTC 3410       3420       3430       3440       3450       3460       3470       3480       3490       3500
         |          |          |          |          |          |          |          |          |          |
A ATCCTTCTCCCTTATTGTCCTTTCGTGTATTGTTCATCCAGCAACCAGGATGATCTTGTTAAAACATTAAACAGATTCTGTCAYKCTTTMAAAAAAAAA
B ATCCTTCTCCCTTATTGTCCTTTCGTGTATTGTTCATCCAGCAACCAGGATGATCTTGTTAAAACATTAAACAGATTCTGTCAYKCTTTMAAAAAAAAA
C ATCCTTCTCCCTTATTGTCCTTTCGTGTATTGTTCATCCAGCAACCAGGATGATCTTGTTAAAACATTAAACAGATTCTGTCAYKCTTTMAAAAAAAAA
D ATCCTTCTCCCTTATTGTCCTTTCGTGTATTGTTCATCCAGCAACCAGGATGATCTTGTTAAAACATTAAACAGATTCTGTCAYKCTTTMAAAAAAAAA
E ATCCTTCTCCCTTATTGTCCTTTCGTGTATTGTTCATCCAGCAACCAGGATGATCTTGTTAAAACATTAAACAGATTCTGTCAYKCTTTMAAAAAAAAA
F ATCCTTCTCCCTTATTGTCCTTTCGTGTATTGTTCATCCAGCAACCAGGATGATCTTGTTAAAACATTAAACAGATTCTGTCAYKCTTTMAAAAAAAAA 3510       3520       3530       3540       3550       3560       3570       3580       3590       3600
         |          |          |          |          |          |          |          |          |          |
A AAAGCCATGAAATTNTAGCAAGCCACTGAATTTGAGTTTTCACTTTGGTTTCTAATATGCTGTGAATCAGANCAGKTTTCTTACCCTTTCTTGGTCTT
B AAAGCCATG-AAATTTAGCAAGCCACTGAATTTGAGTTTTCACTTT-GTTTCTAATATGCTGTGAATCAGANCAGKTTTCTTACCCTTTCTTGGTCTT
C AAAGCCATGAAATTNTAGCAAGCCACTGAATTTGAGTTTTCACTTTGGTTTCTAATATGCTGTGAATCAGANCAGKTTTCTTACCCTTTCTTGGTCTT
D AAAGCCATGAAATTNTAGCAAGCCACTGAATTTGAGTTTTCACTTTGGTTTCTAATATGCTGTGAATCAGANCAGKTTTCTTACCCTTTCTTGGTCTT
E AAAGCCATGAAATTNTAGCAAGCCACTGAATTTGAGTTTTCACTTTGGTTTCTAATATGCTGTGAATCAGANCAGKTTTCTTACCCTTTCTTGGTCTT
F AAAGCCATGAAATTNTAGCAAGCCACTGAATTTGAGTTTTCACTTTGGTTTCTAATATGCTGTGAATCAGANCAGKTTTCTTACCCTTTCTTGGTCTT
```

Fig. 9L

```
      3610       3620       3630       3640       3650       3660       3670       3680       3690       3700
        |          |          |          |          |          |          |          |          |          |
A AATTTCCTTACTGATAAAATGGGGTWGTAATACCTATCTCAAAAAATTATTGCACATATTARATAACATTCCTCTATGTATCTCAATGGCATTAGACATT
B AATTTCCTTACTGATAAAATGGGGTWGTAATACCTATCTCAAAAAATTATTGCACATATTARATAACATTCCTCTATGTATCTCAATGGCATTAGACATT
C AATTTCCTTACTGATAAAATGGGGTWGTAATACCTATCTCAAAAAATTATTGCACATATTARATAACATTCCTCTATGTATCTCAATGGCATTAGACATT
D AATTTCCTTACTGATAAAATGGGGTWGTAATACCTATCTCAAAAAATTATTGCACATATTARATAACATTCCTCTATGTATCTCAATGGCATTAGACATT
E AATTTCCTTACTGATAAAATGGGGTWGTAATACCTATCTCAAAAAATTATTGCACATATTARATAACATTCCTCTATGTATCTCAATGGCATTAGACATT
F AATTTCCTTACTGATAAAATGGGGTWGTAATACCTATCTCAAAAAATTATTGCACATATTARATAACATTCCTCTATGTATCTCAATGGCATTAGACATT 3710       3720       3730       3740       3750       3760       3770       3780       3790       3800
        |          |          |          |          |          |          |          |          |          |
A AGGAGAAGCATTTTGTGGAGGATTTGAAGTTGAGATCTTCATCCAAGAAGAAGTAGCTTTTCAATTTGSTAGAAGCTTAATGTAGCAAGCCACTTCATTTTT
B AGGAGAAGCATTTTGTGGAGGATTTGAAGTTGAGATCTTCATCCAAGAAGAAGTAGCTTTTCAATTTGSTAGAAGCTTAATGTAGCAAGCCACTTCATTTTT
C AGGAGAAGCATTTTGTGGAGGATTTGAAGTTGAGATCTTCATCCAAGAAGAAGTAGCTTTTCAATTTGSTAGAAGCTTAATGTAGCAAGCCACTTCATTTTT
D AGGAGAAGCATTTTGTGGAGGATTTGAAGTTGAGATCTTCATCCAAGAAGAAGTAGCTTTTCAATTTGSTAGAAGCTTAATGTAGCAAGCCACTTCATTTTT
E AGGAGAAGCATTTTGTGGAGGATTTGAAGTTGAGATCTTCATCCAAGAAGAAGTAGCTTTTCAATTTGSTAGAAGCTTAATGTAGCAAGCCACTTCATTTTT
F AGGAGAAGCATTTTGTGGAGGATTTGAAGTTGAGATCTTCATCCAAGAAGAAGTAGCTTTTCAATTTGSTAGAAGCTTAATGTAGCAAGCCACTTCATTTTT 3810       3820       3830       3840       3850       3860       3870       3880       3890       3900
        |          |          |          |          |          |          |          |          |          |
A CAGAACTTGTTTACTCATTTATAATATGGAATATAAAATTTGTGCAAGTCAGAGAAGAAGGGTGCCTTAAAAATGTTGTGGCCAAGCCACATGAGATCAAAGA
B CAGAACTTGTTTACTCATTTATAATATGGAATATAAAATTTGTGCAAGTCAGAGAAGAAGGGTGCCTTAAAAATGTTGTGGCCAAGCCACATGAGATCAAAGA
C CAGAACTTGTTTACTCATTTATAATATGGAATATAAAATTTGTGCAAGTCAGAGAAGAAGGGTGCCTTAAAAATGTTGTGGCCAAGCCACATGAGATCAAAGA
D CAGAACTTGTTTACTCATTTATAATATGGAATATAAAATTTGTGCAAGTCAGAGAAGAAGGGTGCCTTAAAAATGTTGTGGCCAAGCCACATGAGATCAAAGA
E CAGAACTTGTTTACTCATTTATAATATGGAATATAAAATTTGTGCAAGTCAGAGAAGAAGGGTGCCTTAAAAATGTTGTGGCCAAGCCACATGAGATCAAAGA
F CAGAACTTGTTTACTCATTTATAATATGGAATATAAAATTTGTGCAAGTCAGAGAAGAAGGGTGCCTTAAAAATGTTGTGGCCAAGCCACATGAGATCAAAGA
```

Fig. 9M

```
      3910       3920       3930       3940       3950       3960       3970       3980       3990       4000
        |          |          |          |          |          |          |          |          |          |
A CACACTTTCATGACCTCAAATGTGGGCCCAGCCTAGGTCAGCCCAACCCCCATCCAACCCTTAGACTCACGAACAAATCCACCTGAGATCAGCAGAGCCA
B CACACTTTCATGACCTCAAATGTGGGCCCAGCCTAGGTCAGCCCAACCCCCATCCAACCCTTAGACTCACGAACAAATCCACCTGAGATCAGCAGAGCCA
C CACACTTTCATGACCTCAAATGTGGGCCCAGCCTAGGTCAGCCCAACCCCCATCCAACCCTTAGACTCACGAACAAATCCACCTGAGATCAGCAGAGCCA
D CACACTTTCATGACCTCAAATGTGGGCCCAGCCTAGGTCAGCCCAACCCCCATCCAACCCTTAGACTCACGAACAAATCCACCTGAGATCAGCAGAGCCA
E CACACTTTCATGACCTCAAATGTGGGCCCAGCCTAGGTCAGCCCAACCCCCATCCAACCCTTAGACTCACGAACAAATCCACCTGAGATCAGCAGAGCCA
F CACACTTTCATGACCTCAAATGTGGGCCCAGCCTAGGTCAGCCCAACCCCCATCCAACCCTTAGACTCACGAACAAATCCACCTGAGATCAGCAGAGCCA 4010       4020       4030       4040       4050       4060       4070       4080       4090
        |          |          |          |          |          |          |          |          |
A CCCTAGATCAGCTGAAACTCTAAGCACACAAAAATAAAAACTTATCACTGTAAAAAAAAAAAAAAAAAAAAGAAAGCACCTGCCCGGGCCGGCCGCCC
B CCCTAGATCAGCTGAAACTCTAAGCACACAAAAATAAAAACTTATCACTGTAAAAAAAAAAAAAAAAAAAAGAAAGCACCTGCCCGGGCCGGCCGCCC
C CCCTAGATCAGCTGAAACTCTAAGCACACAAAAATAAAAACTTATCACTGTAAAAAAAAAAAAAAAAAAAAGAAAGCACCTGCCCGGGCCGGCCGCCC
D CCCTAGATCAGCTGAAACTCTAAGCACACAAAAATAAAAACTTATCACTGTAAAAAAAAAAAAAAAAAAAAGAAAGCACCTGCCCGGGCCGGCCGCCC
E CCCTAGATCAGCTGAAACTCTAAGCACACAAAAATAAAAACTTATCACTGTAAAAAAAAAAAAAAAAAAAAGAAAGCACCTGCCCGGGCCGGCCGCCC
F CCCTAGATCAGCTGAAACTCTAAGCACACAAAAATAAAAACTTATCACTGTAAAAAAAAAAAAAAAAAAAAGAAAGCACCTGCCCGGGCCGGCCGCCC
```

Fig. 9N

```
MI289  ATGAACTGGCACATGATCATCTCGGGGCTTATCGTAGTAGTGATCAAAGTTGTTGGAATG    60
            ||||||||||||||||||||||||||| ||||||||| |||||||||||||||||||
HI289  ATGAACTGGCACATGATCATCTCTGGGCTTATTGTGGTAGTGCTTAAAGTTGTTGGAATG    60

MI289  ACCTTTTTTCTGCTGTATTCCCACAGGTTTTTGGCAAAAGTAATGATGGCTTCGTCCCC    120
            ||||| ||||||| ||| |||||||||||||||||||  ||||||| |||| ||||
HI289  ACCTTATTTCTACTTTATTCCCACAGATTTTTAACAAAAGTAACGATGGTTTCACCACC    120

MI289  ACGGAGAGCTACGGAACCACTAGTGTGCAGAATGTCTCACAGATCTTTGGGAGAAATGAC    180
            |||||||||||| |||| ||       ||| ||| ||||||| |||||||||| ||
HI289  ACCAGGAGCTATGGAACA------GTCTCACAGATTTTTGGGAGCAGTTCCCCAAGTCCC    174

MI289  GAAAGTACCATGCCTACAAGGAGCTATGGAACAGTCTGTCCCAGAAAACTGGGATTTTCAC    240
            |||||||| ||||||||||||||||||||||   ||||||||||||||||||||| |
HI289  AACGGCTTCATTACCACAAGGAGCTATGGAACAGTCTGCCCCAAAGACTGGGAATTTTAT    234

MI289  CAAGGAAAATGCTTTTCTTCTCCTTCCGAATCACCTTGGAAAGACAGCATGGATTAT    300
            ||||||||||||| ||| |||| |||||||||| ||||||||||||||||| ||||
HI289  CAAGCAAGATGTTTTTTTCTTATCCACTTCTGAATCATCTTGGAATGAAAGCAGGGACTTT    294
```

Fig. 11A

```
MI289  TGTGCAACACAAGGATCCACACTGGCAATTGTCAACACTCCAGAGAAACTGAAGTATCTT  360
            || |||| |||||||| ||||||||||||||||| ||||| ||||||||||||| |||
HI289  TGCAAAGGAAAAGGATCCACATTGGCAATTGTCAACACGCCAGAGAAACTGAAGTTTCTT  354

MI289  CAGGACATAGCTGGTATTGAGAATTACTTTATTGGTTTGGTTACGTCAGCCTGGAGAGAAA  420
            |||||||| |||||| |||||||||| |||||||||||||| ||||| ||||||||||
HI289  CAGGACATAACTGATGCTGAGAAGTATTTTATTGGCTTAATTTACCATCGTGAAGAGAAA  414

MI289  AAGTGGCGCTGGATCAACAACTCTGTGTTCAATGGCAATGTTACCAATCAGGACCAGAAC  480
            ||||| ||||||||||||||||||| |||||||||||||||| ||||| |||| |||
HI289  AGGTGGCGTTGGATCAACAACTCTGTTTTCAATGGCAATGTTACATCATCCAATCAGAAT  474

MI289  TTCGACTGTGTCACTATAGGTCTGACGAAGACATATGATGCTGCATCATGTGAAGTCAGC  540
            ||||||||||| ||||| |||| |||| ||||| ||||| | |||||||||||| |||
HI289  CAGAATTTCAACTGTGCCACCATTGGCCTAACAAAGACATTTGATGCTGGTGACATCAGC  534

MI289  TATCGCTGGATCTGCGAAATGAATGCCAAA  570
            | ||||| |||||||| || |||||||||
HI289  TACCGCAGGATCTGTGAGAAGAATGCCAAA  564
```

Fig. 11B

```
DKFZ  G--------------------GGGCA------------------------------------
         :                 :::::
I309  GCTGTTTCTTGGTGGTGTTGGAATGGTGGGCACAGTGGCTGTCACTGTCATGCCTCAGTGGAGAGTGTCG
             10        20        30        40        50        60        70

DKFZ  ----------------------------------------------------------------------

I309  GCCTTCATTGAAAACAACATCGTGGTTTTTGAAAACTTCTGGGAAGGACTGTGGATGAATTGCGTGAGGC
             80        90       100       110       120       130       140

DKFZ  ----------------------------------------------------------------------

I309  AGGCTAACATCAGGATGCAGTGCAAAATCTATGATTCCCTGCTCTTTCTCCGGACCTACAGGCAGC
            150       160       170       180       190       200       210

DKFZ  ----------------------------------------------------------------------

I309  CAGAGGACTGATGTGTGCTGCTTCCGTGATGTCCTTCTTGGCTTTCATGATGGCCATCCTTGGCATGAAA
            220       230       240       250       260       270       280

DKFZ  ----------------------------------------------------------------------

I309  TGCACCAGGTGCACGGGGACAATGAGAAGGTGAAGGCTCACATTCTGCTGACGGCTGGAATCATCTTCA
            290       300       310       320       330       340       350
```

Fig. 14A

```
DKFZ    ------------------------------------------------------------
I309    TCATCACGGGCATGGTGGTGCTCATCCCTGTGAGCTGGGTTGCCAATGCCATCATCAGAGATTTCTATAA
             360       370       380       390       400       410       420

DKFZ    ------------------------------------------------------------
I309    CTCAATAGTGAATGTTGCCCAAAAACGTGAGCTTGGAGAAGCTCTCTACTTAGGATGGACCACGGCACTG
             430       440       450       460       470       480       490

DKFZ    ------------------------------------------------------------
I309    GTGCTGATTGTTGGAGGAGCTCTGTTCTCTGCTGCGTTTTTTGTTGCAACGAAAAGAGCAGTAGCTACAGAT
             500       510       520       530       540       550       560

DKFZ    ------------------------------------------------------------
I309    ACTCGATACCTTCCCATGCCACAACCCAAAAAAGTTATCACACGGGAAAGAAGTCACCGAGCGTCTACTC
             570       580       590       600       610       620       630

DKFZ    ------------------------------------------------------------
I309    CAGAAGTCAGTATGTGTAGTTGTGTATGTTTTTTTAACTTTACTATAAAGCCATGCAAATGACAAAAATC
             640       650       660       670       680       690       700
```

Fig. 14B

```
DKFZ  ------------------------------------------------------------
I309  TATATTACTTTCTCAAAAATGGACCCCAAAGAAACTTTGATTTACTGTGTTCTTAACTGCCTAATCTTAATTA
            710       720       730       740       750       760       770

10        20
DKFZ  ---------------------------GAATGAGATATTAAACCCAATGC
                                 :::::::::::::::::::::
I309  CAGGAACTGTGCATCAGCTATTTATGATTCTATAAGCTATTTCAGCAGAATGAGATATTAAACCCAATGC
            780       790       800       810       820       830       840

30        40        50        60        70        80        90
DKFZ  TTTGATTGTTCTAGAAAGTATAGTAATTTGTTTTTCTAAGGTGGTTCAAGCATCTACTCTTTTTATCATTT
      :::::::::::::::::::::::::::::::::::::::::::::::::::::::::::::::::::::
I309  TTTGATTGTTCTAGAAAGTATAGTAATTTGTTTTTCTAAGGTGGTTCAAGCATCTACTCTTTTTATCATTT
            850       860       870       880       890       900       910

100       110       120       130       140       150       160
DKFZ  ACTTCAAAAATGACATTGCTAAAGACTGCATTATTTTACTACTGTAATTTCTCCACGACATAGCATTATGT
      :::::::::::::::::::::::::::::::::::::::::::::::::::::::::::::::::::::
I309  ACTTCAAAAATGACATTGCTAAAGACTGCATTATTTTACTACTGTAATTTCTCCACGACATAGCATTATGT
            920       930       940       950       960       970       980
```

Fig. 14C

```
        170       180       190       200       210       220       230
DKFZ ACATAGATGAGTGTAACATTTATATCTCACATAGAGACATGCTTATATGGTTTTATTTAAAAATGAAATGC
     ::::::::::::::::::::::::::::::::::::::::::::::::::::::::::::::::::::::
I309 ACATAGATGAGTGTAACATTTATATCTCACATAGAGACATGCTTATATGGTTTTATTTAAAAATGAAATGC
        990      1000      1010      1020      1030      1040      1050

240       250       260       270       280       290       300
DKFZ CAGTCCATTACACTGAATAAAATAGAACTCAACTATTGCTTTTCAGGGAAATCATGGATAGGGTTGAAGAA
     ::::::::::::::::::::::::::::::::::::::::::::::::::::::::::::::::::::::
I309 CAGTCCATTACACTGAATAAAATAGAACTCAACTATTGCTTTTCAGGGAAATCATGGATAGGGTTGAAGAA
       1060      1070      1080      1090      1100      1110      1120

310       320       330       340       350       360       370
DKFZ GGTTACTATTAATTGTTTTAAAAACAGCTTAGGGATTAATGTCCTCCATTTATAATGAAGATTAAAATGA
     :::::::::::::::::::::: :::::::::::::::::::::::::::::::::::::::::::::::
I309 GGTTACTATTAATTGTTT-AAAAACAGCTTAGGGATTAATGTCCTCCATTTATAATGAAGATTAAAATGA
       1130      1140      1150      1160      1170      1180

380       390       400       410       420       430       440
DKFZ AGGCTTTAATCAGCATTGTAAAGGAAATTGAATGGCTTTCTGATATGCTGTTTTTTAGCCTAGGAGTTAG
     ::::::::::::::::::::::::::::::::::::::::::::::::::::::::::::::::::::::
I309 AGGCTTTAATCAGCATTGTAAAGGAAATTGAATGGCTTTCTGATATGCTGTTTTTTTAGCCTAGGAGTTAG
       1190      1200      1210      1220      1230      1240      1250
```

Fig. 14D

```
              450        460        470        480        490        500        510
DKFZ  AAATCCTAACTTCTTTATCCTCTTCTCCCAGAGGCTTTTTTTCTGTGTATTAAATTAACATTTTTAA
      ::::::::::::::::::::::::::::::::::::::::::::::::::::::::::::::::::
I309  AAATCCTAACTTCTTTATCCTCTTCTCCCAGAGGCTTTTTTTCTGTGTATTAAATTAACATTTTTAA
              1260       1270       1280       1290       1300       1310       1320

520        530        540        550        560        570        580
DKFZ  AAAGCAGATATTTGTCAAGGGGCTTTGCATTCAAACTGCTTTTCCAGGGCTATACTCAGAAGAAAGATA
      ::::::::::::::::::::::::::::::::::::::::::::::::::::::::::::::::::
I309  AAAGCAGATATTTGTCAAGGGGCTTTGCATTCAAACTGCTTTTCCAGGGCTATACTCAGAAGAAAGATA
              1330       1340       1350       1360       1370       1380       1390

590        600        610        620        630        640        650
DKFZ  AAAGTGTGATCTAAGAAAAAAGTGATGGTTTAGGAAAGTGAAAATATTTTGTTTTTGTATTGAAGAAG
      ::::::::::::::::::::::::::::::::::::::::::::::::::::::::::::::::::
I309  AAAGTGTGATCTAAGAAAAAAGTGATGGTTTAGGAAAGTGAAAATATTTTGTTTTTGTATTGAAGAAG
              1400       1410       1420       1430       1440       1450       1460

660        670        680        690        700        710        720
DKFZ  AATGATGCATTTTGACAAGAAATCATATATGTATGGATATATTTAATAAGTATTTGAGTACAGACTTTG
      ::::::::::::::::::::::::::::::::::::::::::::::::::::::::::::::::::
I309  AATGATGCATTTTGACAAGAAATCATATATGTATGGATATATTTAATAAGTATTTGAGTACAGACTTTG
              1470       1480       1490       1500       1510       1520       1530
```

Fig. 14E

```
         730        740        750        760        770        780        790
DKFZ AGGTTTCATCATATATAAAGAGCAGAAAAATATAAAGAGCAGAAAAATATGTCTTGGTTTTCATTTGCTTACCAAAAAACAA
     ::::::::::::::::::::::::::::::::::::::::::::::::::::::::::::::::::::::::::::::::::
I309 AGGTTTCATCAATATATAAAGAGCAGAAAAATATGTCTTGGTTTTCATTTGCTTACCAAAAAACAA
     1540       1550       1560       1570       1580       1590       1600

800        810        820        830        840        850        860
DKFZ CAACAAAAAAGTTGTCCTTTGAGAACTTCACCTGCTCCTATGTGGGTACCTGAGTCAAAATTGTCATTT
     ::::::::::::::::::::::::::::::::::::::::::::::::::::::::::::::::::::::
I309 CAACAAAAAAGTTGTCCTTTGAGAACTTCACCTGCTCCTATGTGGGTACCTGAGTCAAAATTGTCATTT
     1610       1620       1630       1640       1650       1660       1670

870        880        890        900        910        920        930
DKFZ TTGTTCTGTGAAAAATAAATTTCCTTCTTGTACCATTTCTGTTTAGTTTTACTAAAATCTGTAAATACTG
     ::::::::::::::::::::::::::::::::::::::::::::::::::::::::::::::::::::::::
I309 TTGTTCTGTGAAAAATAAATTTCCTTCTTGTACCATTTCTGTTTAGTTTTACTAAAATCTGTAAATACTG
     1680       1690       1700       1710       1720       1730       1740

940        950        960        970        980        990        1000
DKFZ TATTTTTCTGTTTATTCCAAATTTGATGAAACTGACAATCCAATTTGAAAGTTTGTGTCGACGTCTGTCT
     ::::::::::::::::::::::::::::::::::::::::::::::::::::::::::::::::::::::::
I309 TATTTTTCTGTTTATTCCAAATTTGATGAAACTGACAATCCAATTTGAAAGTTTGTGTCGACGTCTGTCT
     1750       1760       1770       1780       1790       1800       1810
```

Fig. 14F

```
I309    G---------------CTGTTTCTTGGTGGTGTTGGAATGGTGGGCACAGTGGCTG
                        ::: :   :::::::::::::  ::::: ::::::::::::
CLAUD8  ATGGCAACCTACGCTCTTCAAATGGCTGCACTGGTGGTTGGCATGGTGGCACGGTGGCTG
                10        20        30        40        50        60        70

I309    TCACTGTCATGCCTCAGTGGAGAGTGTCGGCCCTTCATTGAAAACAACATCGTGGTTTTTGAAAACTTCTG
        :::::::::::::::::::::::::::: ::::::::::::  ::  ::::::  :::::  :::  :::
CLAUD8  TGACTATCATGCCTCAGTGGAGAGTGTCTGCCTTCATCGAAAGTAACATTGTGGTGTTTGAGAACCGCTG
                80        90       100       110       120       130       140

I309    GGAAGGACTGTGGATGAATTGCGTGAGGCAGGCTAACACATCAGGATGCAAAATCTATGATTCCCTG
        :::::::::::::::::::::  :::::::::::::::::::::::::::::::::::::::::::::
CLAUD8  GGAAGGCTTGTGGATGAATTGTATGAGGCATGCCAACATGCCAGAATGCAAGGTCTACGACTCCCTG
                150       160       170       180       190       200       210

I309    CTGGCTCTCTTTCTCCGGACCTACAGGCCAGCAGGACTGATGTGTGCTGCTTCCGTGATGTCCTTCTTGG
        :::::::::: :::::::::::::::::::::  ::: : :::: ::::::::::::::: :: :: ::
CLAUD8  CTGGCTCTTAGTCCAGACCTCCCAGGCATCCCAGAGGACTGATGTGTGCTGCTGTCCGTCCGTCTTTCTTGG
                220       230       240       250       260       270       280
```

Fig. 15A

```
         260        270        280        290        300        310        320
I309   CTTTCATGATGGCCATCCTTGGCATGAAATGCACCAGTGCACGGGGACAATGAAGATGAGAAGGTGAAGGCTCA
       :::::::::::::::::::: :: :::::::::::::::::::::: :: ::::::::::::::  ::::::
CLAUD8 CTTTCATGACAGCCATCCTCGGAATGAAGTGCACCAGTGCACGGGACGATGAGAAGTGAAGAGCCG
         290        300        310        320        330        340        350

330        340        350        360        370        380        390
I309   CATTCTGCTGACGGCTGGAATCATCTTCATCATCACGGGCATGGTGTGCTCATCCCTGTGAGCTGGGTT
       ::: ::::::::: ::::::::::::::::::::::::::::::::::::::::::::: ::::::::
CLAUD8 CATCTTGCTGACAGCCGGAATCATCTTCATCACCGGCTTGGTTGTGCTCCTGTCAGCTGGGTT
         360        370        380        390        400        410        420

400        410        420        430        440        450        460
I309   GCCAATGCCATCATCATCAGAGATTTCTATAACTCAAATAGTGTTGCCCAAAAACGTGAGCTTGGAGAAG
       :::::: ::::::::::::::::::::::::  :: :::: :: ::::::  ::::::::::::::::::
CLAUD8 GCCAATTCCATCATCATCAGAGACTTCTACAACCCCACTGGTGTGCCCTAAAGCGCGAGCTGGGAGAAG
         430        440        450        460        470        480        490

470        480        490        500        510        520        530
I309   CTTCTCTACTTAGGATGGCTGGACCACGGCACTGGTGCTGATTGTTGGAGGAGCTCTGTTCTGCTTTTTG
       :::::::::::: :::::::::::::::::::::::: :::::::::::::::::::::::::: :::::
CLAUD8 CCCTCTACATAGGCTGGACCACCAGCGCTGGAGTGCTGATCGCTGGAGGAGCACTGTTCGTGTTTTG
         500        510        520        530        540        550        560
```

Fig. 15B

```
              540        550        560        570        580        590        600
I309   TTGCAACGAAAAGAGCAGTAGCTACAGATACTCGATACCTTCCCATCGCACAACCCAAAAAGTTATCAC
          ::  ::::::::::   ::  ::::::::::  :::::::::::::::::  ::::::::::::  ::
CLAUD8 TTGTACTGAAAGGAGCAACAGTTACAGTCGGTACTCGGTACCCCATCGCACCACTCGACGGAGTTCCAC
              570        580        590        600        610        620        630

610        620        630        640        650        660        670
I309   ACCGGAAAGAAGTCACCGAGCGTCTACTCCAGAAGTCAGTATGTGTAGTTGTGTATGTTTTTTAACTTT
           ::::::::::::  :::::::::::::::::::  ::::::::: ::::::::::
CLAUD8 GCCGAAAAGAGATCTCCGAGCATATACTCCAAAAGTCAGTATGTGTAG-----------------
              640        650        660        670

680        690        700        710        720        730        740
I309   ACTATAAAGCCATGTGCAAATGACAAAAATCTATATTACTTTCTCAAAATGGACCCCAAAGAAACTTGATT
CLAUD8 ----------------------------------------------------------------------

750        760        770        780        790        800        810
I309   TACTGTTCTTAACTGCCTAATCTTAATTACAGGAACTGTGCATCAGCTATTTATGATTCTATAAGCTATT
CLAUD8 ----------------------------------------------------------------------
```

Fig. 15C

```
            820         830         840         850         860         870         880
             |           |           |           |           |           |           |
I309  TCAGCAGAATGAGAGATATTAAACCCAATGCTTTGATTGTTCTAGAAAGTATAGTAATTGTTTTCTAAGGT
CLAUD8 ------------------------------------------------------------------------

890         900         910         920         930         940         950
             |           |           |           |           |           |           |
I309  GGTTCAAGCATCTCTACTCTCTTTTATCATTTACTTCAAATGACATTGCTAAAGACTGCATTATTTTACTAC
CLAUD8 ------------------------------------------------------------------------

960         970         980         990        1000        1010        1020
             |           |           |           |           |           |           |
I309  TGTAATTTCTCCACGACATAGCATTATGTACATAGATGAGTGTAACATTTATATCTCACATAGAGACATG
CLAUD8 ------------------------------------------------------------------------

1030        1040        1050        1060        1070        1080        1090
             |           |           |           |           |           |           |
I309  CTTATATGGTTTTATTTAAAATGAAATGCCAGTCCATTACACTGAATAAATAGAACTCAACTATTGCTTT
CLAUD8 ------------------------------------------------------------------------

1100        1110        1120        1130        1140        1150        1160
             |           |           |           |           |           |           |
I309  TCAGGGAAATCATGGATAGGGTTGAAGAAGGTTACTATTAATTGTTTAAAAACAGCTTAGGGATTAATGT
CLAUD8 ------------------------------------------------------------------------
```

Fig. 15D

```
        1170      1180      1190      1200      1210      1220      1230
I309  CCTCCATTTATAAATGAAGATTAAAATGAAGGCTTTAATCAGCATTGTAAAGGAAATTGAATGGCTTTCTG
CLAUD8 ----------------------------------------------------------------------

1240      1250      1260      1270      1280      1290      1300
I309  ATATGCTGTTTTTTAGCCTAGGAGTTAGAAATCCTAACTTCTTTATCCTCTTCTCCCAGAGGCTTTTTTT
CLAUD8 ----------------------------------------------------------------------

1310      1320      1330      1340      1350      1360      1370
I309  TTTCTTGTGTATTAAATTAACATTTTTAAAAAGCAGATATTTTGTCAAGGGGCTTTGCATTCAAACTGCTT
CLAUD8 ----------------------------------------------------------------------

1380      1390      1400      1410      1420      1430      1440
I309  TTCCAGGGCTATACTCAGAAGAAAGATAAAAAGTGTGATCTAAGAAAAAGTGTGATGGTTTTAGGAAAGTGAA
CLAUD8 ----------------------------------------------------------------------
```

Fig. 15E

```
             1450      1460      1470      1480      1490      1500      1510
I309  AATATTTTTGTTTTTGTATTTGAAGAAGAATGATGCATTTGACAAGAAATCATATATGTATGGATATAT
CLAUD8 ------------------------------------------------------------------

1520      1530      1540      1550      1560      1570      1580
I309  TTTAATAAGTATTTGAGTACAGACTTTGAGGTTTCATCAATATAAAGAGCAGAAAATATGTCTT
CLAUD8 ------------------------------------------------------------------

1590      1600      1610      1620      1630      1640      1650
I309  GGTTTTCATTTGCTTACCAAAAAACAACAAAAAGTGTCCTTTGAGAACTTCACCTGCTCCTAT
CLAUD8 ------------------------------------------------------------------

1660      1670      1680      1690      1700      1710      1720
I309  GTGGGTACCTGAGTCAAAATTGTCATTTTTTGTTCTGTGAAAATAAATTCCTTCTGTACCATTTCTGT
CLAUD8 ------------------------------------------------------------------

1730      1740      1750      1760      1770      1780      1790
I309  TTAGTTTTACTAAAATCTGTAAATACTGTATTTTTCTGTTTATTCCAAATTTGATGAAACTGACAATCCA
CLAUD8 ------------------------------------------------------------------
```

Fig. 15F

```
           1800       1810       1820       1830       1840       1850       1860
I309   ATTTGAAAGTTTGTGTCGACGTCTGTCTAGCTTAAATGAATGTGTTCTATTTGCTTTATACATTTATATT
CLAUD8 ------------------------------------------------------------------

I309   AATAAATTGTACATTTTTCTAAAAAAAAAAAAAAAAAAAAA
CLAUD8 -----------------------------------------
```

Fig. 15G

```
          10        20        30        40        50        60        70
CLAUD8  MATYALQMAALVLGGVGMVGTVAVTIMPQWRVSAFIESNIVVFENRWEGLMWNCMRHANIRMQCKVYDSL
        :::::::::::::::::::::::::::::::::::::::::::::::::::::::::::::
I309    ------LFLGGVGMVGTVAVTVMPQWRVSAFIENNIVVFENFWEGLMWNCVRQANIRMQCKIYDSL
                  10        20        30        40        50        60

80        90        100       110       120       130       140
CLAUD8  LALSPDLQASRGLMCAASVLAFLAFMTAILGMKCTRCTGDDENVKSRILLTAGIIFFITGLVVLIPVSWV
        :::::::::::::::::::::::::::::::::::::::::::::::::::::::::::::
I309    LALSPDLQAARGLMCAASVMSFLAFMMAILGMKCTRCTGDNEKVKAHILLTAGIIFFIITGMVVLIPVSWV
                  70        80        90        100       110       120       130

150       160       170       180       190       200       210
CLAUD8  ANSIIRDFYNPLVDVALKRELGEALYIGWTTALVLIAGGALFCCVFCCTERSNSYRYSVPSHRTTQRSFH
        :::::::::::::::::::::::::::::::::::::::::::::::::::::::::::::
I309    ANAIIRDFYNSIVNNVAQKRELGEALYLGWTTALVLIVGGALFCCVFCCNEKSSSYRYSIPSHRTTQKSYH
                  140       150       160       170       180       190       200

220
CLAUD8  AEKRSPSIYSKSQYV
        :::::::::::
I309    TGKKSPSVYSRSQYV
                  210
```

Fig. 16

```
I309 ..........LFLGGVGMVGTVAVTVMPQWRVSAFIENNIVVFENFWEGL  40
hCPE MASMGLQVMGIALAVLGWLAVMLCCALPMWRVTAFIGSNIVTSQTIWEGL  50
mCPE MASMGLQVLGISLAVLGWLGIILSCALPMWRVTAFIGSNIVTAQTSWEGL  50
rRPV .MSMSLEITGTSLAVLGWLCTIVCCALPMWRVSAFIGSSIITAQITWEGL  49

I309 WMNCVRQANIRMQCKIYDSLLALSPDLQAARGLMCAASVMSFLAFMMAIL  90
hCPE WMNCVVQSTGQMQCKVYDSLLALPQDLQAARALVIISIIVAALGVLLSVV 100
mCPE WMNCVVQSTGQMQCKMYDSMLALPQDLQAARALMVISIIVGALGMLLSVV 100
rRPV WMNCV.QSTGQMQCKMYDSLLALPQDLQAARALIVVSILLAAFGLLVALV  98

I309 GMKCTRCTGDNEKVKAHILLTAGIIFIITGMVVLIPVSWVANAIIRDFYN 140
hCPE GGKCTNCLED.ESAKAKTMIVAGVVFLLAGLMVIVPVSWTAHNIIQDFYN 149
mCPE GGKCTNCMED.ETVKAKIMITAGAVFIVASMLIMVPVSWTAHNVIRDFYN 149
rRPV GAQCTNCVQD.ETAKAKITIVAGVLFLLAAVLTLVPVSWSANTIIRDFYN 147

I309 SIVNVAQKRELGEALYLGWTTALVLIVGGALFCCVFCCNEKSSSYRYSIP 190
hCPE PLVASGQKREMGASLYVGWAASGLLLLGGGLLCC.NCPPRTDKPYSAKYS 198
mCPE PMVASGQKREMGASLYVGWAASGLLLLGGGLLCCSCPPRSNDKPYSAKYS 199
rRPV PLVPEAQKREMGTGLYVGWAAAALQLLGGALLCCSCPPREKYAPTKILYS 197

I309 SHRTTQKSYHTGKKSPSVYSRSQYV 215
hCPE AARSAAASNYV.............. 209
mCPE AARSVPASNYV.............. 210
rRPV APRSTGPGTGTGTAYDRKTTSERPGARTPHHHHYQPSMYPTRPACSLASET 248
```

```
human    MKRLLLLLFLFFITFSSAFPLVRMTENEENMQLAQAYLNQFYSLEIEGNHLVQSKNRSLIDDKI
         ::  ::          ::::: ::    ::::::::::::::::::::: :::::::::: ::
murine   MKCLLSLMVNFITLSAAFPPDRKDKNEENNQLAQAYLNQFYSLEIEGSHFVQSKNRSLFDGKL
                 10        20        30        40        50        60 human    REMQAFFGLTVTGKLDSNTLEIMKTPRCGVPDVGQYGYTLPGWRKYNLTYRIINYTPDMARAAVDEAIQE
         ::::::::::::::::: ::::: :::::::::::::::::::::::::: ::::::: :::::::
murine   REMQAFFGLTVTGKLDSDTLAIMKVPRCGVPDVGQYGYTLPGWRKYSLTYRIMNYTPDMTPADVDEAIQK
                 70        80        90       100       110       120       130 human    GLEVWSKVTPLKFTKISKGIADIMIAFRTRVHGRCPRYFDGPLGVLGHAFPPGPGLGGDTHFDEDENW-T
           ::::::::: :: ::::: ::::::::::::  :::: ::::::::: :::::::: ::::: ::: ·
murine   ALQVWSKVTPLTFTRISKGVADIMIAFRTGVHGWCPRHFDGPLGVLGHAFPPGLGLGGDTHFDEDETWIA
                140       150       160       170       180       190       200 human    KDGAGFNLFLVAAHEFGHALGLSHSNDQTALMFPNYVSLDPRKYPLSQDDINGIQSIYGGLPKVPAKPKE
         ::: ::::::::::::::: ::::::::::::::::: :::: ::::::::: ::::::: ::   ::
murine   KDGEGFNLFLVAAHEFGHSLGLSHSNDQTALMFPNYISLDPSKYPLSQDDIDGIQSIYGSPPKVTTKPSG
                210       220       230       240       250       260       270
```

Fig. 22A

```
                   280        290        300        310        320        330        340
human      PTIPHACDPDLTFDAITTFRREVMFFKGRHLWRIYYDITDVEFELIASFWPSLPADLQAAYENPRDKILV
           . :::::  ::::::::::::::::::::::::::::::  ::  ::::: ::::::::::::::::  ::::
murine     NSEPHACDPTLTFDAITTFRREVMFFKGRHLWRVYSDIAGAEFEFIDSFWPSLPADLQAAYESPRDELLV
                   280        290        300        310        320        330        340

350        360        370        380        390        400        410
human      FKDENFWMIRGYAVLPDYPKSIHTLGFPGRVKKIDAAVCDKTTRKTYFFVGIWCWRFDEMTQTMDKGFPQ
           :::::::::::: :::: :::::::::::: :::::::::::::::: :::::::::::::::  :::::
murine     FKDENFWVIRGYSVLPGYPKSIHTLGFPRRVKKIDAAVCDHDTRKTFFFVGIWCWRYDEMAQAMDRGFPQ
                   350        360        370        380        390        400        410

420        430        440        450        460        470        480
human      RVVKHFPGISIRVDAAFQYKGFFFFSRGSKQFEYNIKTKNITRIMRTNTWFQCKEPKNSSFGFDINKEKA
            :::::::::: ::: :: :::: ::::: ::: ::::  :::::::::::: :::::: : :
murine     RIIKCFPGIRLRVDAVFQHNGFLYFFHGSRQFEYDMKAKNITQVIKTNSWFLCNEPLNASFNVSV-KGKA
                   420        430        440        450        460        470        480

490        500        510
human      HSGGIKILYHKSLSLFIFGIVHLLKNTSIYQ
            :::   ::::::::: :::::: : :::
murine     NSIGTVILHHKRLSLLTFSIVHVLTKTYN
                   490        500        510
```

Fig. 22B

```
human   CGGACGCGGTGGGCGGAGCGTGGGCAGCTGAAGAAAGAGAGGAATGAAGCGCCTTCTGCTTCTGTTTT
                                                                                10        20        30        40        50        60        70
murine  -----GCTTT-------------AACTGAAGA--GACAGGAATGAAGTGCCTTCTGTCTCTGATGGT
                                  10        20        30        40 human   GTTCTTTATAACATTTTCTTCTGCATTTCCCTTAGTCCGGATGACGGAAAAATGAAGAAATATGCAACTG
           80        90       100       110       120       130       140
murine  TAATTTTATAACATTTTCCGCTGCATTTCCCAGACAGGAAGGACAAAAATGAGGAGAACAACCAACTG
            50        60        70        80        90       100       110 human   GCTCAGGCATATCTCAACCAGTTCTACTCTCTTGAAATAGAAGGGAATCATCTTGTTCAAAGCAAGAATA
          150       160       170       180       190       200       210
murine  GCCCAGGCATATCTCAACCAGTTCTACTCTCTTGAAATAGAAGGGAGTCATTTTGTTCCAAAGCAAGAACA
           120       130       140       150       160       170       180 human   GGAGTCTCATAGATGACAAAAATTCGGGAAAACTTCGGGCATTTTTTGGATTGACAGTGACTGGAAAAACTGGA
          220       230       240       250       260       270       280
murine  GGAGTCTCTTTGATGGAAAACTTTCGGGAAAATGCAGGCATTTTTCGGATTGACAGTGACTGGAAAAACTGGA
           190       200       210       220       230       240       250
```

Fig. 23A

```
human   CTCAAACACCCTTGAGATCATGAAGACACCCAGTGTGCCTGATGTGGGCCAGTATGGCTACACC
        ::::: :::: :: :::::::: :: ::::::::::::: : ::::::::::::::::::::::
murine  TTCAGACACACTTGCGATCATGAAAGTGCCCAGTGTGCCCAGTGTGGGCAATATGGCTACACA
        260       270       280       290       300       310       320 human   CTCCCTGGGTGGAGAAAATACAACCTCACCTACACAGAATAAACTATACTCCGGATATGGCACGAGCTG
        :::::::::::::::::: ::: ::::::: ::::::::::::::  ::::::::::::::::::::
murine  CTCCCTGGGTGGAGAAAATACAGCCTTACATACAGAATAATGAACTATACTCCTGATATGACACCAGCTG
        330       340       350       360       370       380       390 human   CTGTGGATGAGGCTATCCAAGAAGGTTTAGAAGTGTGGAGCAAAGTCACTCCACTAAAATTCACCAAGAT
        ::::::::::::::::::::::::::::::::::::::::::::::::::::::: ::::::::::::
murine  ATGTGGATGAGGCTATTCAGAAAGTCTCAAGTTGGAGCAAGGTCACTCCACTGACGTTTACCAGGAT
        400       410       420       430       440       450       460 human   TTCAAAGGGGATTGCAGACATCATGATTGCCTTTAGGACTCGAGTCCATGGTCGGTGTCCTCGCTATTTT
        : :::::::: ::::::::::  ::: :::::: :: ::::::::::::::::::::::::: ::: ::
murine  ATCCAAGGGGTTGCAGATATAATGATAGCATTCAGGACCATTCAGGAGTCCATGGTGTCCTCGTCACTTT
        470       480       490       500       510       520       530
```

Fig. 23B

```
human   GATGGTCCCTTGGGAGTGCTTGGCCATGCCCTTTCCTCCTGGTCCGGGTCTGGGTGGTGACACTCATTTG
        :::::: ::::::::::::::::::: ::::::::::::::::::::::::: :::::::::::::: :::
murine  GATGGTCCTCTGGGAGTCCTTGGCCTTGGCCATGCCCTTTCCTCCTGGTCCGGGTCTGGGTCTAGGTGTGGTGACACTCACTTTG
        540       550       560       570       580       590       600 human   ATGAGGATGAAAACTGGA---CCAAGGATGGAGCAGGATTCAACTTGTTTCTTGTGGCTGCTCATGAATT
        :: :::::::::::::::   ::::::::::::::::::::::::::::::::::::::::::::::::
murine  ACGAAGATGAAACATGGATAGCCAAGGATGGGGAAGGGTTCAACTTGTTTCTTGTGGCTGCTCATGAATT
        610       620       630       640       650       660       670 human   TGGTCATGCCACTGGGGCTCTCTCACTCCAATGATCAAACAGCCTTGATGTTCCCAAATTATGTCTCCCTG
        ::::::::::::::::::::::::::::::::::::::::::::::::::::::::::::::::::::
murine  TGGTCACTCTCTGGGGCTGTCCCCACTCCAATGATCAAACAGCCTTGATGTTCCCAATTACATCTCCCTG
        680       690       700       710       720       730       740 human   GATCCCAGAAAATACCCACTTTCTCAGGATGATATCAATGGAATCCAGTCCATCTATGGAGGTCTGCCTA
        :::::: :::::::::::::::::::::::::::::::: ::::::::::::::::::::::::::::
murine  GATCCTAGCAAATACCCACTTTCTCAGGATGATATTGATGGAGTCCAGTCCATCTATGAAGTCCACCTA
        750       760       770       780       790       800       810
```

Fig. 23C

```
                840        850        860        870        880        890        900
human    AGGTACCTGCTAAGCCAAAGGAACCCACTATACCCCATGCCTGTGACCCTGTGACTTGACTTTTGACGCTAT
         :::::::::::::::::::::::: :: :::::::::: :::::::::::::::::::::::::::::  ::::
murine   AGGTAACCACCAAGCCAAGTGGAAATTCTGAACCCCACGCCTGTGACCCACTTGACTTTTGATGCTAT
         820        830        840        850        860        870        880

910        920        930        940
human    CACAACTTTCCGCAGAGAAGTAATGTTCTTTAAAGGCAGG----------------------------
         :::::::::::::::::: :::::::::::::: :::::::
murine   CACTACTTTCCGCAGGGAAGTTATGTTCTTTAAAGGCAGGTAAACCTATTCCCTTGACACTCCAGCTTCT
         890        900        910        920        930        940        950 human    ----------------------------------------------------------------------
murine   TATAAAGATGTTTTTTTTTTTCAAAGGATCTCCGGATAAACAGTCTTCTACTCAGCTAGAAAGCCAGTTG
         960        970        980        990        1000       1010       1020 human    ----------------------------------------------------------------------
murine   CTGAGCATGTACCAGTACATCAGCAAGAGATTCTTCCTCAAGAAACAATGTAGAAAACAATCAAAGAAAA
         1030       1040       1050       1060       1070       1080       1090
```

Fig. 23D

```
human    ------------------------------------------------------------
          950
murine   CACCCAAGGGCAACCTGCAGCCTCCACACATAAGCACACATGCATTCACATGTATGCCCCACACATATGTGA
         1100      1110      1120      1130      1140      1150      1160 human    ------------------------------------------------------------
murine   ACATGTAGGCACACATGCATGCATACCACAAACCACAAACTTAAGACTGAAACATGCTGATGGACACAGG
         1170      1180      1190      1200      1210      1220      1230 human    ------------------------------------------CACCTATGGAGGATCTATTATGATATCA
                                                           960       970
murine   TACCAGGACATCATTGATGAAATATTTTGTGTTTAATGCAGGCACTTATGGAGGTCTACTCTGATATTG
         1240      1250      1260      1270      1280      1290      1300 human    CGGATGTTGAGTTTGAATTAATTGCTTCATTCTGGCCATCTCTGCCAGCTGATCTGCCAAGCTGCATACGA
         980       990      1000      1010      1020      1030      1040
murine   CTGGTGCTGAGTTTGAGTTTATTGATTCCTTCTGGCCATCTCTGCCAGCTGATCTTCAAGCTGCCTATGA
         1310      1320      1330      1340      1350      1360      1370
```

Fig. 23E

```
            1050       1060       1070       1080       1090       1100       1110
human   GAACCCCAGAGATAAGAGATTCTGGTTTTTAAAGATGAAAACTTCTGGATGATCAGAGGATATGCTGTCTTG
        ::::::::::::::::::::: :: :::::::: :::::::::::::::::::::::::::::::::::::
murine  AAGCCCCAGAGATGAGCTCCTTGTTTTTAAAGATGAGAATTCTGGGTCATCAGGGATATTCTGTCTTG
          1380       1390       1400       1410       1420       1430       1440

1120       1130       1140       1150       1160       1170       1180
human   CCAGATTATCCCAAATCCATACATTAGGTTTTCCAGGACGTGTGAAGAAAATAGATGCAGCCGTCT
        :: ::::::::::::::::::::: :::::::::::::::::::::::::::::: ::::::::::
murine  CCCGGGTTACCCCAAATCCATCCACACTCGGATTTCCAAGACGTGTGAAGAAAATTGATGCAGCCGTCT
          1450       1460       1470       1480       1490       1500       1510

1190       1200       1210       1220       1230       1240       1250
human   GTGATAAGACCACAAGAAAAAACCTACTTCTTTGTGGGCATTTGGTGCTGGAGTTTGATGAAATGACCCA
        :::: :: : :::::::::::::::: :::::::::::::::::::::::::::::::::::::::::::
murine  GTGATCATGATGATACAAGAGGATTCCCAGAGAAAACACTTTCTTTGTTGGCATCTGGTGCTGGAGTATGAGATGGCACA
          1520       1530       1540       1550       1560       1570       1580

1260       1270       1280       1290       1300       1310       1320
human   AACCATGGACAAAGGATTCCCGCAGAGAGTGGTAAAACACTTTCCTGGAATCAGTATCCGTGTTGATGCT
        :::::::::::: :::::::::::::::::::::::: ::::::: ::::::::::::::::: ::::::
murine  AGCAATGGACAGAGGATTCCCACAGAGGATTCCCAGGAATAAAGTGCTTCCCAGGAATTCGCCTCCCGTGTGGATGCT
          1590       1600       1610       1620       1630       1640       1650
```

Fig. 23F

```
human    GCTTTCCAGTACAAAGGATTCTTCTTTTCAGCCGTGGATCAAAGCAATTTGAATACAACATTAAGACAA
            1330      1340      1350      1360      1370      1380      1390
         : :  : : : : : :  : : : : : : : : : : : : : : : : : : : : : : : : : : : : :
murine   GTCTTCCAACATAAATGGAATTCCTCTATTTCTTCTCCATGGGTCGAGGCAATTTGAATATGACATGAAGGCGA
            1660      1670      1680      1690      1700      1710      1720 human    AGAATATTACCCGAATCATGAGAATACTTGGTTTCAATGCAAAGAACCAAAGAACTCCTCATTTGG
            1400      1410      1420      1430      1440      1450      1460
         : : : : : : : : : : : : : : : : : : : : : : : : : : : : : : : : : : : :
murine   AAAATATCACCCAAGTGATCAAAACCAATTCTTGGTTCCTGTAACGAACCATTAAACGCATCATTCAA
            1730      1740      1750      1760      1770      1780      1790 human    TTTTGATATCAACAAGGAAAAAGCACATTCAGGAGGCATAAAGATATTGTATCATAAGAGTTTAAGCTTG
            1470      1480      1490      1500      1510      1520      1530
         : : : : : : : : : : : : : : : : : : : : : : : : : : : : : : : : : : : :
murine   TGTCAGTGTCA---AAGGAAAAGCAAATTCAATTGGCACAGTGATATTACATCATAAAGGTTAAGCTTG
            1800      1810      1820      1830      1840      1850      1860 human    TTTATTTTTTGGTATTGTTGTTCATTTGCTGAAAAAACACTTCTATTTATCAATAAATTC-----ATAGACCTAA
            1540      1550      1560      1570      1580      1590      1600
         : :  : : : : : : : : : : : : : : : : : : : : : : : : : : : :
murine   CTCACTTTCAGTATTGTTCATGTGCTGACAAAAATCAATTAACAATACAATTCCACAAATAAACCAAA
            1870      1880      1890      1900      1910      1920      1930
```

Fig. 23G

```
human    A------ATAAACCT------CAACAGG----------------------------------------
          :      ::::::       ::::::
murine   ACAAATCTTTTAACCTGAACTCTGCCTCAGGAAGACTCAAGAGTGGGAGAGATGACCCAGTGGTTAAGTG
             1940          1950          1960          1970          1980          1990          2000

1620                    1630
human    ------TCTTTTAATA----------TAAATTCT-----------------------------------
          :::::  :::         :::::::
murine   CACTGGCTGCTCTCTTCAAAGGACCCAGGTTTGATTCTCAGTACCCACATGGCAGTCCACAGCTCTCTGTA
             2010          2020          2030          2040          2050          2060          2070 human    ------------GCTTC----------------------------------------------------
                     :: ::
murine   ACTCCAGACCCAGGGAAATCTGATGCCCTCTCTGGCCTCTGAGGGCACTGCACAAGCATGGTGCATAGAC
             2080          2090          2100          2110          2120          2130          2140

1640    1650                        1660
human    ----------------------------AAAATAGAATAAAA---------------------CC--ATTCTT
                                     :::::::: :::::                     ::   ::::::
murine   ATATACATGCAAGCAAACGGCTATATATTTAAAATAAATGAAAAAGTAAAATAATTGAGCCCAATTCTT
             2150          2160          2170          2180          2190          2200          2210
```

Fig. 23H

```
human       1670
            TAACAACAA----------------------------------------------------
            :::::::::
murine      TAGCATCAAGTTCTTACTCCTACTATATATCAGTGGGTAACCAATAACCAGTTAAAGTATCTGATTCTT
            2220      2230      2240      2250      2260      2270      2280 human       -------------------------------------------------------------
murine      CTAACAGTGAAGTTTTAAATATGACAAAAATCTCTCACTTATTTTGAGTCTAATTAATGATTTGCAAACT
            2290      2300      2310      2320      2330      2340      2350 human       -------------------------------------------------------------
murine      TGGAAAATTAAAGCATGTCTTAAAAATAAACATTAAAGACAATTCTTAATCCAAAAAAAAAAAAAAAAA
            2360      2370      2380      2390      2400      2410      2420 human                                              1680
                                              ------AAAAAAAAAAAAAA
                                                    ::::::::::::::
murine      AAAAAAAAAAAAAAAAAAAAAAAAAAAAAAAAAAAAAAAAAAAAAAAAAAAAAAAAAAAAA
            2430      2440      2450      2460
```

Fig. 23I

```
              10         20         30         40         50         60
              :    .    :    .    :    .    :    .    :    .    :    .    :
210    M---KRLLLLLFLFFITFSSAFPLVRMTENEENMQLAQAYLNQFYSLEIEGNHLVQSKNRSLIDDKIREMQ
MMP-8  MFSLKTLPFLLLLHVQISKAFPV---SSKEKNTKTVQDYLEKFYQLPSNQYQSTRKNGTNVIVEKLKEMQ
              10         20            30         40         50         60

70         80         90        100        110        120        130
              :    .    :    .    :    .    :    .    :    .    :    .    :    .    :
210    AFFGLTVTGKLDSNTLEIMKTPRCGVPDVGQYGYTL--PGWRKYNLTYRIINYTPDMARAAVDEAIQEGL
MMP-8  RFFGLNVTGKPNEETLDMMKKPRCGVPDSGGFMLTPGNPKWERTNLTYRIRNYTPQLSEAEVERAIKDAF
              70         80         90        100        110        120        130

140        150        160        170        180        190        200
              :    .    :    .    :    .    :    .    :    .    :    .    :    .    :
210    EVWSKVTPLKFTKISKGIADIMIAFRTRVHGRCPRYFDGPLGVLGHAFPPGPGLGGDTHFDEDENWTKDG
MMP-8  ELWSVASPLIFTRISQGEADINIAFYQRDHGDNSP-FDGPNGILAHAFQPGQGIGGDAHFDAEETWTNTS
             140        150        160        170        180        190        200

210        220        230        240        250        260        270
              :    .    :    .    :    .    :    .    :    .    :    .    :    .    :
210    AGFNLFLVAAHEFGHALGLSHSNDQTALMFPNYVSLDPRKYPLSQDDINGIQSIYGGLPKVPAKPKEPTI
MMP-8  ANYNLFLVAAHEFGHSLGLAHSSDPGALMYPNYAFRETSNYSLPQDDIDGIQAIYG-LSSNPIQPTGPST
             210        220        230        240        250        260        270
```

Fig. 24A

```
       280        290        300        310        320        330        340
   210 PHACDPDLTFDAITTFRREVMFFKGRHLMWRIYDITDVEFELIASFWPSLPADLQAAYEN-PRDKILVFK
       : :::::::::::::::         :::  :::: :::::::: ::   ::::::::  :::::::::
MMP-8  PKPCDPSLTFDAITTLRGEILFFKDRYFWRRHPQLQRVEMNFISLFWPSLPTGIQAAYEDFDRDLIFLFK
       280        290        300        310        320        330        340

350        360        370        380        390        400        410
   210 DENFWMIRGYAVLPDYPKSIHTLGFPGRVKKIDAAVCDKTTRKTYFFVGIWCWRFDEMTQTMDKGFPQRV
       :::::::::::::::::: :: ::::::::::::  ::    ::::::  :::::::::     :::::
MMP-8  GNQYWALSGYDILQGYPKDISNYGFPSSVQAIDAAVFYRS--KTYFFVNDQFWRYDNQRFMEPGYPKSI
              350        360        370        380        390        400

420        430        440        450        460        470        480
   210 VKHFPGISIRVDAAFQYKGFFFFSRGSKQFEYNIKTKNITRIMRTNTWFQCKEPKNSSFGFDINKEKAHS
       ::::::::::::: ::::::::::  ::    :::::::::  :::::::::::::::::::
MMP-8  SGAFPGIESKVDAVFQQEHFFHVFSGPRYYAFDLIAQRVTRVARGNKWLNCR-----------------
              420        430        440        450        460

490        500        510
   210 GGIKILYHKSLSLFIFGIVHLLKNTSIYQ
                                   ::
MMP-8  ---------------------------YG
```

Fig. 24B

```
10      ATGAAGGCGCCTTCT----GCTTCTGTGTTTTGTCTTTATAACATTTTCT-TCTGCATTCCCTTAGTCCG
             :::  : : :.     ::::: : :::::  :  ::::: ::  : ::::::  ::::::
MMP-8   ATGTT-CTCCCTGAAGACGCTTCCATTTCTGCTCTTACTC-CATGTGCAGATTTCCAAGGCCTT--TCCT
             10         20        30         40        50          60

70        80        90       100       110       120       130
10      GATGACGGAAAATGAAGAAAATA-TGCAACTGGCTCAGGCATATCTCAACCAGTTCTACTCTCTTGAAAT
           :  :.::    : ::: :  :  :::  :::  :::  ::::  :::: :: : :    ::::
MMP-8   G-TATCTTCTAAAGAGAATAACAAAAACTGT-TCAGGACTACCTGGAAAAGTTCTAC-CAATTACCAA
             70        80         90       100       110        120      130

140       150       160       170       180       190       200
10      AGAAAG-GGAATCATCTTGTTCAAAGCAAGAATAG---GAGTCTCATAGATGACAAAATTCGGGAAATGCA
         :::: :  ::: : :: :::  :::   : ::    :::::::::::::::: :::::::::::::::
MMP-8   GCAACCAGTATCAG--TCTACAAGG-AAGAATGGCACTAATGTGATCGTTGAAAAGCTTAAAGAAAATGCA
           140          150       160        170       180       190      200

210       220       230       240       250       260       270
10      AGCATTTTTTGGATTGACAGTGACTGGGAAAACTGGACTCAAACACCCCTTGAGATCATGAAGACACCCAGG
          ::::  ::: ::::  ::::::   ::::::  ::::  :::  ::::: :: ::::  :::::::::::
MMP-8   GCGATTTTTGGGTTGAATGTGACGGCAAGCCAAATGAGGAAACTCTGGACATGATGAAAAAGCCTCGC
          210         220       230       240        250        260       270
```

Fig. 25A

```
        280         290         300          310         320         330
210  TGTGGGGTGCCTGA-TGTGG-GCCAGTATGGCTACACCC----TCCCTGGGTGGAGAAAATACAACCTCA
     ::::::::::::::   ::::  ::::::::: :::::         ::::::::::::::::::::::::
MMP-8 TGTGGGAGTGCCTGACACAGTGGTGTTTTATGTTAACCCCAAGGAAACCCAAGTGGGAACGCACTAACTTGA
        280         290          300         310         320         330         340

340         350         360         370         380         390         400
210  CCTACAGAATAATAAACTATACTCCGGATATGGCACGAGCTGCTGTGGATGAGCTATCCAAGAGGTTT
     :::::::: :::  :   ::  :  :::::: :::   : : ::::::::::::::::::::::::::
MMP-8 CCTACAGGATTCGAAACTATACCCCCACAGCTGTCAGAGGTAGAAGAGCTATCAAGGATGCCTT
        350         360         370         380         390         400         410

410         420         430         440         450         460         470
210  AGAAGTGTGGAGCAAAGTCACTCCACTAAAATTCACCAAGATTCAAAGGGGATTGCAGACATCATGATT
     .:: .:  :::::::::::::  :::: :::::::::: ::::::::::::::::::::::::::::::
MMP-8 TGAACTCTGGAGTGTTGCATCACCTCTCCATCTTCATCTTCACCAGGATCTCACAGGAGAGCAGATATCAACATT
        420         430         440         450         460         470         480

480         490         500         510         520         530         540
210  GCCTTTAGGACTCGAGTCCATGGTTCGCGCTATTTGATGGTCCCTTGGGAGTGCTTGGCCATG
     :::::::::::::::::::::::::::::::: :: : :::::::::::::::::::::::::
MMP-8 GCTTTTTACCAAGAGATCACGGTGACAATTCTC-CA--TTTGATGGACCCAATGGAATCCTTGCTCATG
        490         500         510         520         530         540
```

Fig. 25B

```
210     550       560       570       580       590       600       610
        CCTTTCCTCCTGGTCCGGGTCTGGGTGTGACACTCATTTGATGAGGATGAAAACTGGACCAAGGATGG
        ::::::: ::::::::::: ::  :: :   :: ::::::::::::::::: :::::::::::: ::
MMP-8   CCTTTCAGCCAGCCAAGGTATTGGAGGAGATGCTCATTTGATGCCGAAGAAACATGGACCAACACCTC
        550       560       570       580       590       600       610

210     620       630       640       650       660       670       680
        AGCAGGATTCAACTTGTTTCTTGTGGCTGCTCATGAATTGGTCATGCACTGGGGCTCTCTCACTCCAAT
        :  ::::  :::::::::::::::: ::::::::::::::::::::   ::::::::::::::::::
MMP-8   CGCAAATTACAACTTGTTTCTTGTTGCTGCTCATGAATTTGGCCATTCTTTGGGGCTCGCTCACTCCTCT
        620       630       640       650       660       670       680

210     690       700       710       720       730       740       750
        GATCAAACAGCCTTGATGTTCCCAAATTATGTCTCCCCTGGATCCCAGAAAATACCCACTTTCTCAGGATG
        :: :::: ::::::::::::::: :  : ::::::  :::: :::::::: ::::::::::::::::::
MMP-8   GACCCTGGTGCCTTGATGTATCCCAACTATGCTTTCAGGGAAACCAGCAACCAGCACTACTCCCCTCAAGATG
        690       700       710       720       730       740       750

210     760       770       780       790       800       810       820
        ATATCAATGGAATCCAGTCCATCTATGGAGGTCTGCCTAAGGTACCTGCTAAGCCAAAGGAACCCACTAT
        :  :: ::: ::::::::: :::::::    :::  :::   :::: ::::::::::::::::::::
MMP-8   ACATCGATGGCATTCAGGCCATTCTATGGA---CTTTCAAGCAACCTATCCAACCTACTGGACCAAGCAC
        760       770       780       790       800       810       820
```

Fig. 25C

```
              830       840       850       860       870       880       890
210   ACCCCATGCCTGTGACCCTGACTTGACGCTATCACAACTTTCCGCAGAGAAGTAATGTTCTTT
      ::::  ::::::::::::::::::::  :::  :::: ::::::  :::::::::::  :::::
MMP-8 ACCCAAACCCTGTGACCCCCAGTTTGACATTTGATGCTATCACCACACTCCGTGGAGAAATACTTTCTTT
              830       840       850       860       870       880       890

900       910       920       930       940       950       960
210   AAAGGCAGGCACCTATGGAGGAT-CTATTATGATATCACGGATGTTGAGTTTGAATTAATTGCTTCATTC
      :::  :::: :::::: ::  ::   : ::::::::::::::::::::::::::::::::::::::::
MMP-8 AAAGACAGGTACTTCTGGAGAAGGCATCCTCAGCTACAAAGA-GTCGAAATGAATTTTATTTCTCTATTC
              900       910       920       930       940       950       960

970       980       990      1000      1010      1020      1030
210   TGGCCATCTCTGCCAGCTGATCTGCAAGCTGCATACGAGAACCC---CAGAGATAAGATTCTGGTTTTA
      ::::::::::::::  :::::  ::::: :::::  ::  ::::   :::::: ::::: :::: :::
MMP-8 TGGCCATCCCTTCCAACTGGTATACAGGCTGCTTATGAAGATTTTGACAGAGAGACCCTCATTTTCCTATTA
              970       980       990      1000      1010      1020      1030

1040      1050      1060      1070      1080      1090
210   AAGATGAAAACTTCTGGATGATCAGAGGATATGCTGTTCTTGCCAGATTATCCCAAATCCATC-CATACAT
      ::: ::::: ::::::::: :::::   ::: ::::::::  ::   :::::: ::::::::: ::::: :
MMP-8 AAGGCAACCAATACTGGGCTCTGAGTGCTATGATATTCTGCAAGGTTATCCCAAGGATATATCAAAAC-T
             1040      1050      1060      1070      1080      1090      1100
```

Fig. 25D

```
1100                 1110       1120       1130       1140       1150       1160
 210 TAGGTTTTCCAGGACGTGTGTGAAGAAATAGATGCAGCCGTCTGTGATAAGACCACAAGAAAAACCTACTT
      : :: :  ::  : :   ::::::  ::::: :  :  :  ::    : :: :::::  ::::::  : ::::
MMP-8 ATGGCTTCCCCAGCAGCGTCCAAGCAATTGACGCAGC----TGTTTTCTACAGAAGTAAAACATACTT
      1110       1120       1130       1140       1150       1160

1170       1180       1190       1200       1210       1220       1230
 210 CTTTGTGGGCATTTGGTGTGCTGGAGGTTTGATGAAATGACCCAAAACCATGGACAAAGGATTCCCGCAGAGA
       : : :::::: : :  : :::::::::::::  ::::: :::::::::::::: : :  : ::::: :  :
MMP-8 CTTTGTAAATGACCAATTCTGGAGATATGAT----------AACCAAAGACAATT------CATGGAGC
      1170       1180       1190       1200       1210

1240       1250       1260       1270       1280       1290       1300
 210 GTGGTAAAACACTTTCCTGGAATCAGTAGTATCCGTGTTGATGCTGCTTTCCAGTACAAAGGATTCTCTTTT
       ::: ::::: : :  ::    :  :   :::::::::  : : ::: :: ::::    :  ::::: :
MMP-8 TATCCCAAAAGCA-TATC----AGGTGC----CTTTCCAGGAATAGAGAGTAAA------
      1220       1230       1240       1250       1260

1310       1320       1330       1340       1350       1360       1370
 210 TCAGCCGTGGATCAAAGCAATTTGAATACAACATTAAGACAAAGAATATTACCCGAATCATGAGAACTAA
      :: :: :  ::   ::   :: ::: : :::   ::: :  ::  ::  ::::: :::: :  ::::::
MMP-8 CAGGT---GTTGAT----GCAGTTT----TCCAGCA----AGAACATTC---TTC------
      1270       1280       1290       1300
```

Fig. 25E

```
       1380      1390      1400      1410      1420      1430      1440
    TACTTGGTTTCAATGCAATGCAAAGAACCAAAGAACTCCTCATTTGGTTTTGATATCAACAAGGAAAAAGCACAT
       : :  .    : :  .  .  : : : : : : : : : : : .  : : : .   : : : : : : : :
210 MMP-8 --CATG---TC--TTCAGTGGACCAAGATATTACGCCATTTGATCTT-ATTGCT-CAGAGAGTTA-C----
                 1310      1320      1330      1340      1350

1450      1460      1470      1480      1490      1500      1510
    TCAGGAGGCATAAAGATATTGTATCATAAGAGTTTAAGCTTGTTTATTTTTGGTATTGTTCATTTGCTGA
       : : :  . : : :          . : :          . :          :  .  : : : :
210 MMP-8 ----GTTGCAAGAG-------GCA-----ATAAATGG-------C-TTAACTGT
                    1370             1380                  1390

1520      1530
    AAAACACTTCTATTTATCAA
      : : :    . : : :
210 MMP-8 -CAGA--------TATGGC--
         1360              1400
```

Fig. 25F

```
         10         20         30         40         50         60         70
human MNMSVLTLQEYEFEKQFNENENEAIQWMQENWKKSFLFSALYAAFIFGGRHLMNKRAKFELRKPLVLMSLTL
murine ----------------------------------------------------------------------

80         90        100        110        120        130        140
human AVFSIFGALRTGAYMVYILMTKGLKQSVCDQGFYNGPVSKFWAYAFVLSKAPELGDTIFIILRKQKLIFL
                                      ::::::::::::::::::::::::::::::::::::
murine ------------------------------LKQSVCDQSFYNGPVSKFWAYAFVLSKAPELGDTIFIILRKQKLIFL
                                             10         20         30         40

150        160        170        180        190        200        210
human HWYHHITVLLLYSWYSYKDMVAGGGWFMTMNYGVHAVMYSYYALRAAGFRVSRKFAMFITLSQITQMLMGC
      ::::: :::::::::::::::::::::::::::::::::::::::::::::::::::::::::::::::
murine HWYHHITVLLLYSWYSYKDMVAGGGWFMTMNYGVHAVMYSYYALRAAGFRVSRKFAMFITLSQITQMLMGC
          50         60         70         80         90        100        110

220        230        240        250        260
human VVNYLVFCWMQHD--QCHSHFQNIFWSSLMYLSYLVLFCHFFFEAYIGKMRKTTKAE
      : :::: :: ::  :::::::::::::::::::::::::::::::::::  :::::
murine VINYLVFNWMQHDNDQCYSHFQNIFWSSLMYLSYLVLFCHFFFEAYIGKVKKATKAE
         120        130        140        150        160        170
```

Fig. 31

```
         10        20        30        40        50        60        70
human ATGAACATGTCAGTGTTGACTTTACAAGAATATGAATTCGAAAAGCAGTTCAACGAGAATGAAGCCATCC
murine ------------------------------------------------------------------

80        90       100       110       120       130       140
human AATGGATGCAGGAAAAACTGGAAGAAATCTTTCCTGTTTTCTGCTCTCGTATGCCTGCCTTTATATTCGGTGG
murine ------------------------------------------------------------------

150       160       170       180       190       200       210
human TCGGCCACCTAATGAATAAACGAGCAAAGTTTGAACTGAGGAAGCCATTAGTGCTCTCTGACCCTT
murine ------------------------------------------------------------------

220       230       240       250       260       270       280
human GCAGTCTTCAGTATATTCGGTGCTCTTCGAACTGGTGCTTATATGGTGTACATTTGATGACCAAAGGCC
murine ---------------------------------------------------------------::C
```

Fig. 32A

```
                    290        300        310        320        330        340        350
human    TGAAGCAGTCAGTTTGTGACCAGGGTTTTTACAATGGACCTGTCAGCAAATTCTGGGCTTATGCATTTGT
         ::::::::::::::::::::::::::::::::::::::::::::::::::::::::::::::::::::::
murine   TGAAGCAGTCAGTTTGTGACCAGAGTTTTTACAATGGACCTGTCAGCAAATTCTGGGCTTATGCATTTGT
          10         20         30         40         50         60         70

360        370        380        390        400        410        420
human    GCTAAGCAAAGCACCCGAACTAGGAGATACAATATTCATTATTCTGAGGAAGCAGAAGCTGATCTTCCTG
         :::  :::::::::::::::::::::   ::::::::::::  ::::::::::::  ::::::::::::
murine   GCTCAGCAAAGCACCCGAACTAGGTGACACGGATATTCATCATTCTGAGGAAACAGAAACTGATCTTCCTG
          80         90        100        110        120        130        140

430        440        450        460        470        480        490
human    CACTGGTATCACCACACTGTGCTCCTGTACTCTCTTGGTACTCCTACAAAGACATGGTTGCCGGGGAG
         ::::::::: :::::::::::::::::::::::::::::::::::::::::::::::::::::::::::
murine   CACTGGTACCACCACACTGTGCTCCTGTACTCCTGTACTCCTACAAAGACATGGTTCGCTGGGGTG
         150        160        170        180        190        200        210

500        510        520        530        540        550        560
human    GTTGGTTCATGACTATGAACTATGGCGTGCACGCCCGTGATGTACTCTTACTATGCCTTGCGGGCGGCAGG
         :::::::::::::::::::::::::::::::::::::::::::::::::::::::::::::::::::::
murine   GTTGGTTCATGACTATGAACTATGGCGTGCATGCCGTGCCTTACTACGCCTTACTACGCCTTGCGGGCTGCCGGGG
         220        230        240        250        260        270        280
```

Fig. 32B

```
              570       580       590       600       610       620       630
human  TTTCCGAGTCTCCCGGAAGTTTGCCATGTTCATCACCTTGTCCCAGATCACTCAGATGCTGATGGGCTGT
       ::::::::::::::::::::::::::::::::::::::::::::::::::::::::::::::::::::::
murine TTTCCGAGTCTCCCGGAAGTTTGCCATGTTCATCACCTTGTCCCAGATCACTCAGATGCTGATGGGCTGT
          290       300       310       320       330       340       350

640       650       660       670       680       690
human  GTGGTTAACTACCTGGTCTTCTGCTGCTGGATGCAGCATGAC-----CAGTGTCACTCTCACTTTCAGAACA
       :::::::::::::::::::::::::::::::::::::::::     :::::::::::::::::::::::::
murine GTCATTAACTACCTGGTCTTCTGCTGCTGGATGCAGCATGACAACGACCAGTGTCACTCCCACTTTCAGAACA
          360       370       380       390       400       410       420

700       710       720       730       740       750       760
human  TCTTCTGGTCCCTCACTCATGTACCTTCAGCTACCTGTGCTCTTCTGCCATTTCTTCTTTGAGGCCTACAT
       ::::::::::::::::::::::::::::::::::::::::::::::::::::::::::::::::::::::
murine TCTTCTGGTCCCTCGCTCATGTACCTTCAGCTACCTGTGCTCTTCTGCCATTTCTTCTTTGAGGCCTACAT
          430       440       450       460       470       480       490

770       780       790
human  CGGCAAAAATGAGGAAAAACAACGAAAGCTGAA
       :::::::::::::::::::::::::::::::::
murine CGGCAAAGTGAAGAAAAGCCACGAAGGCTGAG
          500       510       520

Fig. 32C
```

```
I400   MDTSMNFSRGLKMDLMQPYDFET-FQDLRPF--LEEYWVSSFLIVVVYLLLIIVGQTYMRTRKSFSLQRP
              10        20        30          40        50        60
                                                      :    :: : :  :::   :
CIG30  MNMSV----LTL---QEYEFEKQFNENEAIQWMQENWKKSFLFSALYAAFIFGGRHLMNKRAKFELRKP
              10        20        30        40        50        60

I400   LILWSFFLAIFSILGTLRMWKFMATVMFTVGLKQTVCFAIYTDDAVVRFWSFLFLLSKVVELGDTAFIIL
              70        80        90        100       110       120       130
       :::: ::  :   ::::  :::::::  :::::   :::::::::::::::::::::::::::::::::
CIG30  LVLWSLTLAVFSIFGALRTGAYMVYILMTKGLKQSVCDQGFYNGPVSKFWAYAFVLSKAPELGDTIFIIL
              70        80        90        100       110       120       130

I400   RKRPLIFVHWYHHSTVLLFTSFGYKNKVPSGGWFMTMNFGVHSVMYTYYTMKAAKLKHPNLLPMVITSLQ
              140       150       160       170       180       190       200
       ::::::: ::::::::::::::::::::::::::::::::::::::::::::::::::::::::::::
CIG30  RKQKLIFLHWYHHITVLLYSWYSYKDMVAGGGWFMTMNYGVHAVMYSYYALRAAGFRVSRKFAMFITLSQ
              140       150       160       170       180       190       200

I400   ILQMVLGTIFGILNYIWRQEKGCHTTEHFFWSFMLYGTYFILFAHFFHRAYLRPKGKVASKSQ
              210       220       230       240       250       260       270
       :::::::::::::::::::::::::::::::::::::::::::::::::::::::  :::::
CIG30  ITQMLMGCVVNYLVFCWMQHDQCHSHFQNIFWSSLMYLSYLVLFCHFFFEAYI-GKMRKTTKAE
              210       220       230       240       250       260
```

Fig. 33

```
              10        20        30        40        50        60
I400  ATGAACATGTCAGTGTTGACTTTACAAGAATATGAATT---CGAAAAGCAGTTCAACGAGAATGAAGC--
      ::  ::::::: :::::: :  :: :::  ::::::::   :: ::::::  :::::::::::: ::
CIG30 ATGGACACATCCATGAATTTCTCACGCGGGTTAAAAATGGACCCTGATGCAACCCTATGACTTCGAGACGT
              10        20        30        40        50        60        70

70        80        90       100       110       120
I400  --CA--TCCAATGG------ATGCAGGAAAACTGGAAGAAATCTTTCCT-GTTTTCTGC-TCTGTATGCT
        ::  :::: ::::      :::::::: :: :::::::: :::::::: :::::::: :::::::::
CIG30 TTCAGGACTTAAGGCCCTTTTTGGAGGAGTACTGGGTAAGCTCATTTCTCATAGTGGTCGTCTATCTGTT
              80        90       100       110       120       130       140

130       140       150       160       170       180       190
I400  GCCTTTATATTCGGTGGTCGGCCACCTA-ATGAATAAACGAGCAAAGTTTGAACT-GAGGAAGCCATTAGT
      :::::::::::::::::::::::::::: :::::::::::::::::::::::::: :::::::::::::::
CIG30 GCCTTTATATTCGGTGGTCGGCCACCTACATGAATAAACGAGCAAAGTTTGAACTGGAGGAAGCCATTAGT
             150       160       170       180       190       200

200       210       220       230       240       250       260
I400  GC--TCATCGTTGTTGGCCAG-ACCTACACATGAGAATCGCGGA-AGAGCTTCAGCTTGCAGAGGCCTCTCAT
      ::   ::: :::::::::::: :::::::::::::::::: :: ::::::::::::::::::::::::::
CIG30 GCTCTCTGGTCTCTGACCCTTGCAGTCTTGCAGTATATTCGGTATCTGTGCTCTTCGAACTGGTGCTTATATGGTGTAC
             210       220       230       240       250       260

270
I400  
CIG30 CCTCTGGTCCTTCCTGGCAATATTCAGTATCCTGGGTACTCTGAGGATGTGGAAGTTTATGGCAACA
             210       220       230       240       250       260       270
```

Fig. 34A

```
            270         280         290         300         310         320
I400  ATTTTGATGACCAAAGGCCTGAAGCAGCAGTCAGTTTG--TGACCAGGGTTTTTACAATGGAC-CTGTCAGCA
      .: .::::::: .: :..:.:: .:::::: .:::: :.::  ::  ::::::::: :. ::::: : :::.
CIG30 GTGATGTTTACAGTGGGCCCTCAAGCAAACCGTGTGCTTTGCCA---TCTACACGGATGACGCCGTAGTCA
            280         290         300         310         320         330         340

330         340         350         360         370         380         390
I400  AATTCTGGGCTTATGCATTTGTGCTAAGCAACCCGAACTAGGAGATACAATATTCATTATTCTGAG
      .:.:::::: :: : : ..:::  :  :..:::::.::::::.:..:.::.::.:::::::::.:
CIG30 GATTCTGGTCGTCCTTCTCTTCTTCAGCAAGGTTGTTGAACTGGGAGACACGGCCTTCATCATCCTGCG
            350         360         370         380         390         400         410

400         410         420         430         440         450         460
I400  GAAGCAGAAGCTGATCTCTTCCTGCACTGGTATCACCACCACTGTGCTCCTGTACTCTTGGTACTCCTAC
      :..:  :.::.:::   ::::::.:: : ::.::::::: :::::: :::: :::. :::::...:::
CIG30 TAAGCGTCCACTCATCTTGTTCCACTGTCCACCACAGCAGCTGTACCACCAGTGCTACTGTTCACAAGTAC
            420         430         440         450         460         470         480

470         480         490         500         510         520         530
I400  AAAGACATGGTTGCCCGG-GGGAGGTTGGTTCATGACTATGAACTATGGCGTCCATTCTGTGATGTACTCT
      :..: .:::: :   .:  ::  ::::::: ::::: :.:::::: :::: :::::::.: :::::::::
CIG30 AAGAACAAAGT-GCCTTCGGGTGGCTGGTTCATGACTTTGGCGTCCATTCTGTGATGTACACT
            490         500         510         520         530         540         550
```

Fig. 34B

```
         540         550         560         570         580         590         600
I400  TACTATGCCTTGCGGGCGGCAGGTTTCCGAGTCTCCCGGAAGTTTGCC---ATGTTCATCACCTTGTCC--
      : :::: ::         :: :::  :::  :: ::: :::::::::: :: :::::::::::::::
CIG30 TACTACACTATGAAGGCTGCCAAA--CTGAAGCATCTTCTCCCCATGGTCATCACCAG--CCTG
         550         560         570         580         590         600         610

610         620         630         640         650         660         670
I400  CAGATCACT-CAGATGCTGATGGGCTGTGTGGTTAACTACCTGGTCTTCTGCTGGATGCAGCATGACCAG
      :::::: :: :  :  : ::::: :: ::::: : :::::::: ::: :: ::: :::::: :: :::
CIG30 CAGAT-TCTGCAGATGGTTCTGGGCACCATCTTTGGGCATACTCTGAATTACATCTGGAGGCAGGAGAAAGGA
         620         630         640         650         660         670         680

680         690         700         710         720         730         740
I400  TGTCACTCTCCACTTTCAGAACA--TCTTCTGGTCCCTCACTCATGTACCTCAGCTACCTTGTGCTCTTCTG
      :: :::::::::: :::::: ::  : :::::::::::: : ::  :: :::: : :: :::::: ::::
CIG30 TGCCACCACA-ACAA-CGGAACACTTCTCTGGTCTCTTCTGGTCTATATGGACCTATTTCATCCTATTCGC
         690         700         710         720         730         740         750

750         760         770         780         790
I400  CCATTTCTTCTTTGAGGCCTACATCGG---CAAAATGAGGAAAACAAC-GAAAGCTGAA
      : ::::: ::: :  : ::: :::: :  :: :::::::   ::: ::::::: ::
CIG30 TCACTTCTTCCACCGACCTCAGGCCCTACCTCAGGGCCCAAGGGTTGCATCCAAGAGCC--AA
         760         770         780         790         800         810
```

Fig. 34C

```
               10        20         30         40         50         60         70
human    MNMSVLTLQEYEFEKQFNENEAIQWMQENWKKSFLFSALYAAFIFGGRHLMNKRAKFELRKPLVLWSLTL
murine   ------------------------------------------------------------------
rat      ------------------------------------------------------------------ human    AVFSIFGALRTGAYMVYILMTKGLKQSVCDQGFYNGPVSKFWAYAFVLSKAPELGDTIFILLRKQKLIFL
murine   ------------LKQSVCDQSFYNGPVSKFWAYAFVLSKAPELGDTIFILLRKQKLIFL
rat      --------------------------------------LGDTIFILLRKQKLIFL human    HWYHHITVLLYSWYSYKDMVAGGGWFMTMNYGVHAVMYSYYALRAAGFRVSRKFAMFITLSQITQMLMGC
murine   HWYHHITVLLYSWYSYKDMVAGGGWFMTMNYGVHAVMYSYYALRAAGFRVSRKFAMFITLSQITQMLMGC
rat      HWYHHITVLLYSWYSYKDMVAGGGWFMTMNYGVHAVMYSYYALRAAGFRVSRKFAMFITLSQITQMLMGC human    VVNYLVFCWMQHD--QCHSHFQNIFWSSLMYLSYLVLFCHFFFEAYIGKMRKTTKAE
murine   VINYLVFNWMQHDNDQCYSHFQNIFWSSLMYLSYLVLFCHFFFEAYIGKVKKATKAE
rat      VINYLVFNWMQHDNDQCYSHFQNIFWSSLMYLSYLLLFCHFFFEAYIGKVKKATKAE
```

Fig. 35

```
             10         20         30         40         50         60         70
H  MTWLVLLGTLLCMLRVGLGTPDSEGFPPRALHNCPYKCICAADDLLSCTGLGLQDVPAELPAATADLDLSH
     :  : :          :         : :::.      .     : ::       :     : ::  ..
P  MN-LDIHCEQLSDARWTELLPLLQQYEVVRLDDCGLTEEHCKDIGS--ALRANPSLTELCLRTNEL---GD
             10         20         30         40         50         60

80         90        100        110        120        130
H  NALQRLRPGWLAPLFQLRALHLDHNELDALGRGVFVNA----SGLRLLDLSSNTLRALGRHDL-DGLGA-
    :: :::  ..   :   :::.           .         :  :::.:       :.    :.:.
P  AGVHLVLQGLQSPTCKIQKLSLQNCSLTEAGCGVLPSTLRSLPTLRELHLSDNPLGDAGIRLLCEGLLDP
     70         80         90        100        110        120        130

140        150        160        170        180        190        200
H  ---LEKLLLFNNRLVHLD-EHAFHGLRALSHLYLGCNELASFSFDHLHGLSATHLLTLDLSSNRLGHISV
        :.:::::: : :   .:   ::.:::::: :.     :  ::.: ::.. :  :::::::: ..
P  QCHLEKLQLEYCRLTAASCEPLASVLRATRAL----KELTVSNND--IGEAGARVLGQGLAD----SA
            140        150        160        170        180        190

210        220        230        240        250        260
H  PELAALPAFLKN-GLYLHNNPLPCDCRLYHLLQRWHQRGLSAVRDFAREYVCLAFKVPASRVR---FFQH
    ::: :  :::   : ::    :  :::  :::   .:: ::.:::  :  ::   :  ::    :.
P  CQLETLR--LENCGLTPANCKDLCGIVASQASLRELDLGSNGLGDAGIAELCPGLLSPASRLKTLWLWEC
       200        210        220        230        240        250        260
```

Fig. 37A

```
            270       280       290       300       310       320
H SRVFENCSSA-PALGLKRPEEHLYALVGRSL------RLYCNTSV-PAMRIAWVSPQQELLRAPGSRDGSI
                :: :  :  ::        ::              ::    :   :    ::
P DITASGCRDLCRVLQAKETLKEL-SLAGNKLGDEGARLLCESLLQPGCQLESLWVKSCSLTAACCQHVSL
            270       280       290       300       310       320       330

330       340       350       360       370       380       390
H AVLADGSLAIGNVQEQHAGLFVCLATGPRLHHNQTHEYNVSVHFPRPEPEAFNTGFTTLLGCAVGLVLVL
                 :  :    :    :    :   :   :   :  :    :   ::  :  : ::
P MLTQNKHL------LELQLSSNKLGDSGIQELCQALSQPGTTLRVLCLGDCEVTNSGCSSLAS---LLLANRS
            330       340       350       360       370       380       390

400       410       420       430       440       450
H LYLFAPPCRCCRRACPLPPLAPNTQPAPRAEPHK-SSVLSTTPPDAPSPQGQASTS-----T
   :  :  :   :   : :    :  ::   ::     :      :  :
P LRELDLSNNCVGDPGVLQLLGSLEQPGCALEQLVLYDTYWTEEVEDRLQALEGSKPGLRVIS
            400       410       420       430       440       450
```

Fig. 37B

```
M    1   ..........................PFLFNHLHGLGLTRLRTLDLSSNWLKHISI   30
                                   |.|||||||||||||| |||||||| |||:
H  151   HAFHGLRALSHLYLGCNELASFSFDHLHGLSATHLLTLDLSSNRLGHISV         200

M   31   PELAALPTYLKNRLYLHNNPLPCDCSLYHLLRRWHQRGLSALHDFEREYT           80
         ||||||:|||||||||||||||||||||||||||||.||||||   |||
H  201   PELAALPAFLKNGLYLHNNPLPCDCRLYHLLQRWHQRGLSAVRDFAREYV          250

M   81   CLVFKVSESRVRFFEHSRVFKNCSVAAAPGLELPEEQLHAQVGQSLRLFC          130
         || |||..|||||| |:|||||||.|:||| |:|||||.:||.|||||.:
H  251   CLAFKVPASRVRFFQHSRVFENCSSAPALGLKRPEEHLYALVGRSLRLYC          300

M  131   NTSVPATRVAWVSPKNELLVAPASQDGSIAVLADGSLAIGRVQEQHAGVF          180
         ||||||.|||||||:||||.|||.||||||||||||||| |||||||||
H  301   NTSVPAMRIAWVSPQQELLRAPGSRDGSIAVLADGSLAIGNVQEQHAGLF          350

M  181   VCLASGPRLHHNQTLEYNVSVQKARPEPETFNTGFTTLLGCIVGLVLVLL          230
         |||| ||||||||:|||||||:| | || |:|||||||||.|||||||
H  351   VCLATGPRLHHNQTHEYNVSVHFPRPEPEAFNTGFTTLLGCAVGLVLVLL          400

M  231   YLFAPPCRGCCHCCQRACRNRCWPRASSPLQELSA..QSSMLSTTPPDAPS         279
         ||||||||      ||     |.||         |.||||||||||||
H  401   YLFAPPCR.......CCRRACPLPPLAPNTQAPRAEPHKSSVLSTTPPDAPS         446

M  280   RKASVHKHVVFLEPGKKGLNGRVQLAVPPDSDLCNPMGLQL                    320

H  447   PQGQASTST...........                                        455
```

Fig. 39

```
         10        20        30        40        50        60        70
M MAPHWAVWLLAAGLWGLGIGAEMWWNLVPRKTVSSGELVTVVRRFSQTGIQDFLTLTLTEHSGLLYVGAR
  ::::::::: :::::: ::::::::::::::::::::::::::::::::::::::::: :::::::::
H MAPHWAVWLLAARLWGLGIGAEVWWNLVPRKTVSSGELATVVRRFSQTGIQDFLTLTLTEPTGLLYVGAR
         10        20        30        40        50        60        70

80        90       100       110       120       130       140
M EALFAFSVEALELQGAISWEAPAEKKIECTQKGKSNQTECFNFIRFLQPYNSSHLYVCGTYAFQPKCTYI
  ::::::: :::::::::::::: :::::::::::::::::::::::::::: :::::::::::::::
H EALFAFSMEALELQGAISWEAPVEKKTECIQKGKNNQTECFNFIRFLQPYNASHLYVCGTYAFQPKCTYV
          80        90       100       110       120       130       140

150       160       170       180       190       200       210
M NMLTFTLDRAEFEDGKGKCPYDPAKGHTGLLVDGELYSATLNNFLGTEPVILRYMGTHHSIKTEYLAFWL
H -----------------------------------------------------------------------

220       230       240       250       260       270       280
M NEPHFVGSAFVPESVGSFTGDDDKIYFFFSERAVEYDCYSEQVVARVARVCKGDMGGARTLQKKWTTFLK
       : ::                     :      :R-
H -----VSAALLP-----------------------------R-----------------------------

290       300       310       320       330       340       350
M ARLVCSAPDWKVYFNQLKAVHTLRGASWHNTTFFGVFQARWGDMDLSAVCEYQLEQIQQVFEGPYKEYSE
  ::  :    : ::
H ----CPQPP-----ALLTL-------------------------L--------------------------
     150
```

Fig. 42A

```
                                                                                                                      420
                     360           370          380         390            400          410
         M QAQKWARYTDPVPSPRPGSCINNWHRDNGYTSSLELPDNTLNFIKKHPLMEDQVKPRLGRPLLVKKNTNF
                        :    :           . : . :                   : :                : : :
         H ----WTR----------GCGPQ--------SPAL-------------KH-------------LLI----TSL
                  160                       170

430           440          450         460            470         480          490
         M THVVADRVPGLDGATYTVLFIGTGDGWLLKAVSLGPWIHMVEELQVFDQEPVESLVLSQSKKVLFAGSRS
               . : :                             : : : : .                . : : :  . . .
         H S-----------------------------VLRTCSPSLW----------------SMESLKMGRA-------SVPMT
           180                                       190                       200

500           510          520         530            540          550          560
         M QLVQLSLADCTKYRFCVDCVLARDPYCAWNVNTSRCVATTSGRSGSFLVQHVANLDTSKMCNQYGIKKVR
           : :     . :          :           : : : :
         H QLRAM--LA--------F-------L-------WMVSCTRPHSTTS--------------------------
               210                                     220

570           580          590         600            610          620          630
         M SIPKNITVVSGTDLVLPCHLSSNLAHAHWTFGSQDLPAEQPGSFLYDTGLQALVVMAAQSRHSGPYRCYS
                                                      :
         H ---------------------------------W--------------------------------------

640           650          660         670            680          690          700
         M EEQGTRLAAESYLVAVVAGSSVTLEARAPLENLGLVWLAVVALGAVCLVLLLVLSLRRRLREELEKGAK
                                                                      . : :
         H --------------------ARNPLS-----------------------------CVT-------------
                                      230

Fig. 42B
```

```
           710        720        730        740        750        760        770
M  ASERTLVYPLELPKEPASPPFRPGPETDEKLWDPVGYYYSDGSLKIVPGHARCQPGGGPPSPPPGIPGQP
                                 :                         :: ::
H  ------------------------------W-------------------------GPTTP--------
                                                           240

780        790        800        810        820        830
M  LPSPTRLHLGGGRNSNANGYVRLQLGGEDRGGSGHPLPLELADELRRKLQQRQPLPDSNPEESSV
H  ----------------------------------------------------------------
```

Fig. 42C

```
M  GGCACGAGGTGGCCCGGAGTCAAACGCCAGGGGCAGCGCCAGGGATTGGAGCTGCACGAAAGAGGGCTGCTG
       10        20        30        40        50        60        70
                :::   :                  ::    :          ::::   :::
H  GTC------GACC------CACG-------CGTC-------CGCG-----GGACAGCTG
                                                          20

M  GACTGAAGTTTAGACCCTGGGCTGTCTGCCATGGCCCCACACTGGGCTGTCTGGCTGCTGGCAGCAGGCT
        80        90       100       110       120       130       140
   :::::::::::  :: :::::: :::::::::::::::::::::::::::::::::::::::::::::
H  GCCTGAAGCTCAGAGCCGGTGCGCGGGGCGTGCCATGGCCCCACACTGGGCTGTCTGGCTGTGGCAGCAAGGCT
         30        40        50        60        70        80        90

M  GTGGGGCCTGGGCATCGGGGCTGAGATGTGGTGGAACCTTGTGCCCCGGAAGACAGTATCTTCTGGGGAG
       150       160       170       180       190       200       210
   :::::::::::::::::::  :::::::::::::::::::::::: ::::::::::::::::::::::
H  GTGGGGCCTGGGCATTGGGGCTGAGGTGTGGTGGAACCTTGTGAAGACAGTGTCTTCTGGGGAG
        100       110       120       130       140       150       160

M  CTGGTCACAGTAGTGAGGCGGTTCTCCCAGACAGGCATCCAGGACTTCCTGACACTGACCCTGACAGAAC
       220       230       240       250       260       270       280
   ::::::::::::::::::::::::::::::::::::::::::::::::::::::::::::::::::::
H  CTGGCCACGGTAGTACGGCGGTTCTCCCAGACACCGGCATCCAGGACTTCCTGACACTTCCTGACGCTGACGGAGC
       170       180       190       200       210       220       230

M  ATTCTGGCCTTTTATATGTGGGGCCCGAGAGGCGCTGTGTTTGCCTTCAGTGTAGAGGCTCTGGAGCTGCA
       290       300       310       320       330       340       350
   :::: :::::::     ::::::: ::::::::::::::::::::::::::::::::::::::::::::
H  CCACTGGGCTTCTGTACGTGGGCGCCCGAGAGGCGCCCTGTTTGCCTTCAGCATGGAGGCCCTGGAGCTGCA
       240       250       260       270       280       290       300
```

Fig. 43A

```
          360        370        380        390        400        410        420
M AGGAGCGATCTCTTGGGAGGCTCCAGCTGAGAAGAAAATTGAATGTACCCAGAAAGGGAAGAGCAACCAG
  ::::::::::::::::::::::::::::  ::  :::::: :::: :::: ::::::::::::::::::
H AGGAGCGATCTCCTGGGAGGCCCCCGTGGGAGAAGAGAAGACTGAGTGTATCCAGAACAACCAACCAG
          310        320        330        340        350        360        370

430        440        450        460        470        480        490
M ACCGAATGCTTCAACTTCATCCGCTTCCTTCAGCCATACAATTCCTCCATCTGTATGTCTGCGCACCT
  :::: ::::::::::::::::::::::::::::: :::::: ::::::::: :::::::::::::::::
H ACCGAGTGCTTCAACTTCATCCGCTTCCTGCAGCCCTACAATGCCTCCCACCTGTACGTCTGTGGCACCT
          380        390        400        410        420        430        440

500        510        520        530        540        550        560
M ATGCCTTCCAGCCCAAGTGCACCTACATCAACATGCTCACGTTCACGTTGGACCGTGCAGAATTTGAGGA
  : ::::::::::::::::::::::::::::::::::: :: ::::           :: :: :: :
H ACGCCTTCCAGCCCAAGTGCACCTACACGTCG---------TGA---GTGC------------
          450        460        470        480

570        580        590        600        610        620        630
M TGGGAAGGGTAAATGCCCATATGACCCAGCTAAGGGTCACACCGGACTCCTTGTGGACGGTGAGCTGTAC
                      :: :: :: ::: :::::  ::                   ::
H ------TGCCCT-----CCTACCTCGGTGTC-C-CCAGCCCCC------------CG-----C
                  490        500        510

640        650        660        670        680        690        700
M TCAGCCACACTCAATAACTTCCTGGGCACAGAGCCGGTTATCCTTCGATACATGGGGACCCACCACTCCA
  ::  : :  ::   :: ::::::  :                                 ::  ::::::
H CCT-CCTCACCC---TTCT--CTGGACTCGTGG------------------ATGTGG--CCCAC------
          520        530        540                            550
```

Fig. 43B

```
        710       720       730       740       750       760       770
M TCAAGAGACAGAGTACCTGGCTTTTTTGGCTGAATGAACCCCACTTTGTAGGCTCTGCCTTTGTCCCTGAGAG
  :::: ::  ::  :::    ::  :::::: ::   :::::  ::: :::::::::  ::::
H --------AGAGCCCTGCCCTTAAGC----------ATCTCCTCATCAC---CTCTCTCCTCTGTCC--TTAGA-
          560       570            580            590       600

780       790       800       810       820       830       840
M TGTGGGAAGCTTCACGGGAGACGATGACAAGATCTACTTCTTCTTCAGTGAGCGGGCAGTGGAGTATGAC
  ::::::: ::::::::: ::::::: :::  ::::: :::::: :::  ::::::: ::  ::::
H --------ACATGCTCACCTTCA-CTT-TG-GAGCA---TGGAGAGTTTGA-
                610         620       630            640

850       860       870       880       890       900       910
M TGCTATTCCGAGCAGGTGGTGGCTCGTGTGGCGAGAGTCTGTAAGGGTGACATGGGGGAGCACGGACGC
                                      :                   :  ::: ::
H ----AGATGG-------GAAGGGCAAGTGTC----------C---------------CTATGACCC
      650             660                                 670

920       930       940       950       960       970       980
M TGCAGAAGAAATGGACGACGTTCCTGAAGGCTCGGTTGGTGTGCTCAGCCCCTGACTGGAAGGTCTACTT
  :::::::: ::::::: :::    ::::::::: :::::::  :: ::::::::::   :::::
H AGCTAAGGGCCATGCTGCCCTTCTTGT-GGATGGTGAGCTGTACTCGGCCAC--ACT-----CAACAA
          690       700              710            720              730

990       1000      1010      1020      1030      1040      1050
M CAACCAGCTGAAGGCGGGTGCACACCCGCCCTCTTGGCACAACCACCTTTCTTCGGGGTTTTT
  ::::::       :::       ::::  ::  :: :::: ::   ::::    :::
H CTTCCTG----GGCA----------CGGAAC-CCA-TTATC---------CTGCG----TAA
      740                   750                  760
                              Fig. 43C
```

```
      1060      1070      1080      1090      1100      1110      1120
M CAAGCGCGATGGGGCGATATGGACCCTGTCTGCAGTTTGTGAGTACCCAGTTGGAACAGATCCAGCAAGTGT
  :: :::::::::     ::       ::        ::::  ::   :  : :::::
H CA------TGGGGC---------CC---C---------------ACCA------C---TCCA--------
        770                                     780

1130      1140      1150      1160      1170      1180      1190
M TTGAGGGTCCCTACAAGGAGTACAGTGAGCAAGCCCAGAAGTGGGCCCGCTATACTGACCCGGTACCCAG
    :::    :  :::::::  ::::::::       ::::::  ::  ::   ::      :::  ::
H -TGAAG-----ACA--GAGTAC-------CTGGCC----TTTTGGCTCAACGAACCTCACTTTGTA---GG
   790            800                810                820         830

1200      1210      1220      1230      1240      1250      1260
M CCCTCGGCCTGGTTCGTGTATCAACAACTGGCACCGAGACAATGGCTACACCAGTTCCCTGGAACTGCCG
  : :::::::   :::   :::  ::   ::::  ::::::::::::: ::            ::
H C--TCTGCCTA-----TGTA-C------CTGA-----GAGT-GTGGGCAGCTTCA------CGGGGACGAC--
       840              850                860        870              880

1270      1280      1290      1300      1310      1320      1330
M GACAACACCCCTCAACTTCATCAAGAAGAAGCACCCCCCTGATGGAGGACCAGGTGAAGCCTCGGTTGGGCCGCC
  ::  ::::::::::::::::: :::::::::                  ::  ::::::::::::::::
H GACAAGGTCTACTTCTTCTTCAGGGAGC-------------------GGGC--AGTGGGAGTC-CGA-------
       890        900                             910        920

1340      1350      1360      1370      1380      1390      1400
M CCCTACTTGTGAAGAAGAACACTAACTTCACACGTGGCCGACAGGGTCCCAGGGCTTGATGGTGC
     ::  ::::::::::         ::                  ::          ::
H ---CTGCTA-----------TGC---CGAGCAGGTGGTGGC----------TC----GTGTGGC
     930                   940                  950

Fig. 43D
```

```
              1410      1420      1430      1440      1450      1460      1470
M  CACCTATACAGTGTTGTTCATTGGTACAGGAGATGGCTGGCTGCTGAAGGCTGTGAGCCTGGGGCCCTGG
    :  :::::  :::  ::  :::::::          :::        :       :           :::
H  C--CGTGTCTG------CAAGGG---C---GATATGGGGGGC-----------GCA------C---GGACCCTG-
     960                    970                 980                  990

1480      1490      1500      1510      1520      1530      1540
M  ATCCACATGGTGGAGGAACTGCAGGTGTTTGACCAGGAGCCAGTGGAAAGTCTGGTGCTGTCTCAGAGCA
                ::  :::::::::       :::::::     :       :  :::  :::::  :::
H  ------CA-----GAGGAA-------GTG---GACCACGTTCCTG----AAGGC----GCGG----CTG-GCA
        1000              1010                 1020                 1030

1550      1560      1570      1580      1590      1600      1610
M  AGAAGGTGCTCTCTTTGCTGGCTCCCCGCTCTCAGCTGGTTCAGCTGTCTCTGGCCGACTGCACAAAGTACCG
    ::::::       ::  ::::::       :::  ::::: ::::::::::       :::         ::
H  ------TGCTCT------GC-CCCGAACT-GGCAG-CTCTACT-TCA---ACCAGCTGCA---GG----CG
        1040              1050              1060              1070       1080

1620      1630      1640      1650      1660      1670      1680
M  TTTCTGTGTAGACTGTGTGCTCCTGGCCAGGGACCCCTTACTGTGCCTGGAATGTCAACACCAGCCGCTGTGTG
         :::::::   :::::  ::::::          :::::::         ::::::::::::::  :::
H  ATGC------ACA---CCCTG--CAGGACACCT--------CCTGGCA------CAACACCACCTTCTTTGGG
       1090             1100              1110              1120          1130

1690      1700      1710      1720      1730      1740      1750
M  GCCACCACCAGTGGTCGCTCGGGGTCCTTTCTGGTCCAACATGTGGGAACTTGGACACTTCAAAGATGT
    ::  :::::             :::         :::::::::::  ::::::         :::::
H  GTTT--TTCAA-------GCACAGTGG-------GGT--GACATGTACCTGTC---GGC-CATCTG---TGA
       1140               1150              1160             1170
```

Fig. 43E

```
              1760       1770       1780       1790       1800       1810       1820
M  GTAACCAGTATGGCATTAAAAAAGTCAGATCTATTCCCAAGAACATCACCGTTGTGTCAGGCACAGACCT
   :::  ::::         ::  :::::                          :: :  :: : :::
H  GTA-CCAGT-TGG-------AAG--AGATC---------------CAGCG--GGTGTTTGAGG-------
              1180                              1190       1200       1210

1830       1840       1850       1860       1870       1880       1890
M  GGTCCTACCCTGCCACCTCTCGTCCAATTGGCCCATGCCCACTTCGGACCTTCGGAAGCCAGGACCTGCCT
            :::   ::::    ::  :: :         :::::  ::        ::::::   :::
H  ------GCC-------------CCTATAAGGA--GTACC---ATGA----GGAAGC------CCA
                        1220             1230           1240

1900       1910       1920       1930       1940       1950       1960
M  GCAGAACAAACCTGGCTCCTTTCTTTATGACACGGGACTCCAGGCGCTGGTGGTGATGGCCGCACAGTCCC
   : :::  .::  :  :::     :::       ::   ::::::: :: : :: :::::::::::
H  GAAGTGGGACC--GCTAC---ACT----GACCCTGTAC--CCAGGCCCCTGGTTGTGATGGCTGCCAGCCC
                1250        1260             1270       1280       1290       1300

1970       1980       1990       2000       2010       2020       2030
M  GTCACTCTGGACCCTATCGTTGCTATTCAGAGGAGCAGGGACAAAGACTGGCTGCAGAAAGCTACCTTGT
   :  :  ::::    ::: :::: : :::::::::::::::: ::::::::::::::::::::::::::
H  GCCATGCCGGGGGCCTACCACTGCTTTTCAGAGAGACAGGGGCGCGGCTGGCTGCTGAAGGCTACCTTGT
     1310       1320       1330       1340       1350       1360       1370

2040       2050       2060       2070       2080       2090       2100
M  TGCTGTCGTGCCGGCTCGTCGGTGACACTGGAGGCACGGGCTCCCTTGGAAAAACCTGGGGCTCGTGTGG
    ::   ::::: :::::   :::  ::::::::::: :::: ::: ::::::::::::::::::::::
H  GGCTGTCGTGGCAGGCCCGTGACCTTGACCTTGGAGGCCCCCCCCTGGAAAAACCTGGGGCTGGTGTGG
      1380       1390       1400       1410       1420       1430       1440
```

Fig. 43F

```
                2110      2120      2130      2140      2150      2160      2170
M  CTCGCTGTGGTGGCCCTGGGGGGCTGTGTGCCTGGTGCTGCTGGTGCCTGGTCCTATCGCTCCGCCGGCGAC
   :: ::::::::::::::::::::::::  ::::::::::::::: :::::::  :::: :::::::::::
H  CTGGCCGGTGGTGGCCCTGGGGGGCTGTGTGCCTGGTGCTGCTGGTGCTGCTGTGTCATTGCGCCGGCGGC
                1450      1460      1470      1480      1490      1500      1510

2180      2190      2200      2210      2220      2230      2240
M  TTCGAGAAGAGCTAGAAAAGGGTGCCAAGGCATCTGAGAGGACACTGGTGTACCCCTTGGAACTGCCCAA
   : ::::::: :::::::::::::::::::::::::::::::: ::::::::::::::::::::::::::
H  TGCGGGAAGAGCTGGAGAAAGGGGCCAAGGCCAAGGCCTACTGAGAGGACCTTGGTGTACCCCCTGGAGCTGCCCAA
                1520      1530      1540      1550      1560      1570      1580

2250      2260      2270      2280      2290      2300      2310
M  GGAGCCTGCCAGTCCCCCCTTCCGTCCTGGCCCCGAAACTGATGAGAAACTTGGGATCCTGTCGGGTAC
   ::::::::::::::::::::::::::::: ::   ::::::::::::::::::::::::::::::::
H  GGAGCCCACCAGTCCCCCCTTCCGGCCCCTGTCCCGGAACCAGATGAGAAACTTTGGGATCCTGTCGGTTAC
                1590      1600      1610      1620      1630      1640      1650

2320      2330      2340      2350      2360      2370      2380
M  TACTATTCGGATGGCTCTCTCAAGATTGTGCCTGGTCACGCCCGGTGCCAGCCTGGGGGTGGGCCCCCTT
   :::::::::::::::::   :::::: ::::::::: ::::::::::::: ::::::::::::::::::
H  TACTATTCAGATGGCTCCCCTTAAGATAGTACCTGGCATGCCCGGTGCCAGCCATGCCCGGTGGGGGGCCCCCTT
                1660      1670      1680      1690      1700      1710      1720

2390      2400      2410      2420      2430      2440      2450
M  CCCCACCTCCTGGCATACCTGGCCAGCCTTCTGCCTTCTCCAACTCGGCTCCACCTAGGAGGTGTCGGAA
   ::::::::::::::::::::::::::::::::::::::::::::::::::::::::::::::::::::
H  CGCCACCTCCCAGGCATCCCCAGGCCAGCCCTCTGCCTTCTCCAACTCGGCTTCACCTGGGGGGTGGGCGGAA
                1730      1740      1750      1760      1770      1780      1790
```

Fig. 43G

```
            2460      2470      2480      2490      2500      2510      2520
M  CTCAAATGCCAATGGTTATGTGCGTTTACAGTTGGGCGGAGAGGACCGAGGAGGATCTGGGCCACCCACTG
   ::::::  ::::::::::  ::::::  :::::::  ::::::  ::::  :::::  ::::  :::::
H  CTCAAATGCCAATGGTTACGTGCGCTTACAACTAGGAGGGGAGGACCGGGGAGGGCTCCGGGCCACCCCTG
            1800      1810      1820      1830      1840      1850      1860

2530      2540      2550      2560      2570      2580      2590
M  CCTGAGCTCGCGGATGAATTACGACGGAAAACTACAACAGCGCCTGCCTGACTCCAACCCAGAGG
   :::::::::::::::::  ::  ::::::  ::::::  :::::::::::::::::::::::::
H  CCTGAGCTCGCGGATGAACTGAGACGCAAACTGCAGCGCCACTGCCCGACTCCAACCCCGAGG
            1870      1880      1890      1900      1910      1920      1930

2600      2610      2620      2630      2640      2650
M  AGTCTTCAGTATGAGGGGACCCCCCCCACCTCATTGGCGGGGGGGTCTCATGGGAGGTGCA-CTCTTAA
   :::  ::::::::::::::  ::::::  :::   ::  :  :::::  ::  :::::::: :::::
H  AGTCATCAGTATGAGGGGAACCCCCC-ACCCGCGTCGGCGGGAAG------CGTGGGAGGTGTAGCTCCTA-
            1940      1950      1960      1970      1980      1990

2660        2670      2680      2690      2700      2710      2720
M  CTTTTGCACAGGCACCAGCTACCTCAGGGACATGCAGGGACACTGCTCTGCCTGGGACAGAGACACTGCC
   ::::::::::::::::::::::::::::::::::::::::::::::::::::::::::::  ::::::
H  CTTTTGCACAGGCACCAGCTACCTCAGGGACATGCAGGGACACGGGCACTGCTCTGTCTGGGACAGATACTGCC
2000        2010      2020      2030      2040      2050      2060

2730        2740      2750      2760      2770      2780      2790
M  CATCATTTGCCCGGCCCGTGAGGACCTGCTC-----AGCATGGGCACTGCCACTTGGTTGTGGCTCACCAGG
   :::     :  ::::::::::::::::::::    ::::  ::::  ::::::::::::::::::::::::
H  CAGCACCCACCCCGGCCATGAGGACCTGCTCTGCTCAGCACGACGCCACTGCCACTTGGTGTGGCTCACCAGG
2070        2080      2090      2100      2110      2120      2130
```

Fig. 43H

```
       2800       2810       2820       2830       2840       2850       2860
M  ACTTCAGCCTCACAGGAGACA-CACCCTCCTCT--GTGAATTTGAGACATGTGGGACCCCAGCAGCCAAA
   :: ::::::::::::::::::  :::::::::::  ::::::: :  ::::::  ::: ::::::::::
H  GCACCAGCCTCGCAGAAGGCATCTTCCTCCTCTCTGTGAATCACAGACACGCGGGACCCCAGCCGCCAAA
       2140       2150       2160       2170       2180       2190       2200

2870       2880       2890       2900       2910       2920
M  ACTTTGCAAGGAAGAGAGTTTCAAGATGTGGGCGTGTTTGTGCAT--ATATGTGTTGGTATGCATGTGGAA
   :: :::::::: ::::::::::::::::::::  :::::::::::  ::::::::::: :::::::::::
H  ACTTTTCAAGGCAGAAGTTTCAAGATGTGTTTGTGTATTGCACATGTGTTTGTGTGTGTGTGTGTGTGTAT
       2210       2220       2230       2240       2250       2260       2270

2930       2940       2950       2960       2970       2980       2990
M  GAATGTGTGTGTGTGTGTG----TGTGTTGTAACTTTCCTGTCTCTATCACGTCTTCCCTTGGCCTGG
   :::::::::::::::: ::    :::::::: :::::: ::::::::::: :::: :::: ::::::
H  GTGTGTGTGTGCACGCGCGCGCTGTGTGGCATAGCCTTGTGTCAAGTCTTCCCTTGTCTTCCCTTGGCCTGG
       2280       2290       2300       2310       2320       2330       2340

3000       3010       3020       3030       3040       3050       3060
M  GGTCCTCCTGGTTGAGTCTTTGGAGCTATGAAGGGGAAGGGTCATAGCACTTTGCTTCTCTCCTACCCCC
   ::::::::::::::  :::: :::::::::::::::: :::: ::: :::: ::::::::: :::::::
H  G-TCCTCCTGGT-GAGTCATTGGAGCTATGAAGGGGAAGGGG-TCGTATCACTTTTGTCTCTCCTACCCCC
       2350       2360       2370       2380       2390       2400       2410

3070       3080       3090       3100       3110       3120       3130
M  AGCTGTCCCAAGCTTTGGGGCAGTGATGTACATACGGGAAGGGAAGGACAGGGTGTTGTACCCCTTTTG
   :  ::::: :::  :::::::::  :::::::::::: ::::  :::::::::::::::::::::: ::
H  A-CTGCCCGAG-TGTCGGGGCAGCAGCGATGTACATATGGAGGTTGGGGTGGACAGGGTGCTGTGCCCCTTCAG
       2420       2430       2440       2450       2460       2470       2480
```

Fig. 43I

```
              3140        3150        3160        3170        3180        3190        3200
    M  GGGGAGTGCGGGACTCGGGGGTGGGCCTAGCCCTGCTCCTAGGGCTGTGAATGTTTTCAGGGCGGGGGTT
       ::::::::::::::: ::  ::::::::::::::::::::::::::::::::::::::: :::::::: :
    H  AGGGAGTGCAGGGCT-TGGGGTGGGCCTAGTCCTGCTCCTAGGGCTGTGAATGTTTTCAGGGTGGGGGGA
              2490        2500        2510        2520        2530        2540        2550

3210        3220        3230        3240        3250        3260        3270
    M  GGGGGTGGAGATGGAACCTCCTGC---TTCAGGGGAGGGTGGGCAGGGCCTCCCACTTGCCCTCCGGG
       :::::::::::::::::::::::     ::::::::::::::::::::::::::::::::: :: :::
    H  GGG-----AGATGGAGCCTCCTGTGTGTTTGGGGGAAGGGCTGGGCCTGGGGCCTCCCACTTGGCCCCGGGG
              2560        2570        2580        2590        2600        2610

3280        3290        3300        3310        3320        3330
    M  TTCGGTGGTATTTTTATATTTGCGCTCTTC-TG-ACAGGGCTGGGAAGGG--TTGTTGGGGAGGGAAGGG
       :::::::::::::::::::::::::::::  :: :::::::::::::::   :::::::::::::::::
    H  TTCAGTGGTATTTTTATACTTGCCTTCTGCCTTCTCTTCCTGTACAGGGCTGGGAAGGCTGTGTGAGGGGAGAGAAGGG
              2620        2630        2640        2650        2660        2670        2680

3340        3350        3360        3370        3380        3390        3400
    M  AGGAGGTGGGCATGCTATGGATACTGGCCTATCCTCTCCCTGCTCTGGGAAAAGGGCT---AACAGTGTA
       ::::::::::::::::::::::::::::::::::::::::::::::::::::::::::   :::::::::
    H  AGAGGGTGGGCCTGCTGTGGACAATGGCATACTCTCTTCCAGCCCCTAGGAGGAGGGCTCCTAACAGTGTA
              2690        2700        2710        2720        2730        2740        2750

3410        3420        3430        3440        3450        3460        3470
    M  ACTTATTGTGTCCCCACATATTTATTTGTTGTAAATATTTGAGTATTTTTATATTGACAAATAAAATGGA
       ::::::::::::::::::::: ::::::::::::::::::::::: ::::::::::::::::::::
    H  ACTTATTGTGTCCCCGCGTATTTATTTGTTGTAAATATTTGAG-ATTTTTATATTGA----------
              2760        2770        2780        2790        2800        2810
```

Fig. 43J

```
G    1 ATGTTTCTGCTTCTGGTGGTACTCAGCCAGCTGCCCAGACTTACCCTCGC     50
       |||||| ||||||||| ||||||| ||||||||||||||   ||||| |
H    1 ATGTTTACGCTTCTGGTTCTACTCAGCCAACTGCCCACAGTTACCCTGGG     50

G   51 GGTTCCTCAT...ACAAGAAGCCTAAAGAGAATTCTGAACATGCCCCAGAAG    97
       ||| ||||||   || ||||||| ||   || || ||||||| |||||||
H   51 GTTTCCTCATTGCGCAAGAGGTCCAAGGCTTCTAAGGCATGCGGGAGAAG    100

G   98 GAGTCTTTGCATCAAAAAAAGCAGCAAGCATCTTTATGCACCGTCGCCTC    147
       ||||| |||||||||||   |||||||||| || ||||||  |||||||
H  101 AAGTGTTTACATCAAAAGAAGCAAAACTTTTCATACATAGACGCCTT    150

G  148 CTATACAATAGATTTGATTTAGAACTCTTCACTCCCGGGAACCTGGAGAG    197
       |||| ||||||||||||| ||||| || ||||||||| ||||| ||||||
H  151 CTGTATAATAGATTTGATCTGGAGCTCTTCACTCCCGGCAACCTAGAAAG    200

G  198 AGAGTGCTATGAGGAGTTCTGTAGTTATGAAGAAGCCAGAGAGATCCTCG    247
       ||||||||| ||||||||||| ||| ||||| |||||||||||| |||
H  201 AGAGTGCAATGAGAAGAACTTTGCAATTATGAGGAAGCCAGAGAGATTTTG    250
```

Fig. 45A

```
G  248 GGGACAACGAAGAAATGATCACATTCTGGCGGGAATATTCAGTCAAAGGA 297
          |||||| ||||| || |||||| |||| ||||||||||||| ||||||
H  251 TGGATGAAGATAAAACGATTGCATTTTGCAGGAATATTCAGCTAAAGGA 300

G  298 CCAACCACAAGATCAGATGTCAACAAAGAGAAAATTGATGTTATGGGCCT 347
          ||||||||||||||||| ||||||||||||||||| ||||||||||||
H  301 CCAACCACAAGATCAGATGGCAACAAAATCAGAGAGAAAATAGATGTTATGGGCCT 350

G  348 TCTGACTGGCTTAATTGCGGCTGGAGTATTCTTGGTTGTTTTTGGCTTAC 397
          |||||||||||||||| |||||||||||| ||||| ||||| |||| |
H  351 TCTGACTGGATTAATTGCTGCTGGAGTATTTTGGTTATTTTTGGATTAC 400

G  398 TTGGTTACTATCTGTGTATCACCAAGTGTAATAGGCAGCCATATCAAGGT 447
          ||| ||||||| |||| |||| ||||||||||||||||| ||||||||
H  401 TTGGCTACTATCTTTGTATCACTAAGTGTAATAGGCTACAACATCCATGC 450

G  448 TCTTCAGCTGTCTACACAAGAAGGACCAGGCACACACCGTCCATCATTTT 497
          |||||||||||||| ||||  |     ||||||||| |||||||||||
H  451 TCTTCAGCCGTCTATGAAAGGGGG...AGGCACACTCCCTCCATCATTTT 497
```

Fig. 45B

```
G  498  CAGAACCCATGAGGAAGCTGTCTTGTCTCCAT...CGTCATCCTCAGAGG  544
            ||||| ||| ||||||||||| || |||||||   |||||||||| |||
H  498  CAGAAGACCTGAGGAGGCTGCCCTTGTCTCCATTGCCGCCCTTCTGTGGAGG  547

G  545  ACGCGGGACTACCTTCCTATGAACAGGCAGTAGCTCTGACCAGAAAACAC  594
            | ||| |||||  |||| ||||||||||||| ||||||||||||||||
H  548  ATGCAGGATTACCTTCTTATGAACAGGCAGTGGCGCTGACCAGAAAACAC  597

G  595  AGTGTCTCACCACCACCTCCATATCCTGGGCCAGCAAAAGGATTTAGGGT  644
            |||| ||||||||||||||||||||||||||| ||||||||||||||||
H  598  AGTGTTTCACCACCACCATATCCTGGGCCACACAAAAGGATTTAGGGT  647

G  645  ATTTAAAAAGTCAATGTCACTCCCCATCTCAC  675
            ||||||||| ||| |||| ||| |||||||||
H  648  ATTTAAAAAATCTATGTCTCCTCCCATCTCAC  678
```

Fig. 45C

```
G    1  MFLLLVVLSQLPRLTLAVPH.TRSLKNSEHAPEGVFASKKAASIFMHRRL    49
          ||.|.|||||||||.|  ||||||.||.|||||.|||||.|||.|||||
H    1  MFTLLVLLSQLPTVTLGFPHCARGPKASKHAGEEVFTSKEEANFFIHRRL    50

G   50  LYNRFDLELFTPGNLERECYEEFCSYEEAREILGDNEEMITFWREYSVKG    99
        |||||||||||||||||||| :|||:|||||||.||:|||||||:|| ||
H   51  LYNRFDLELFTPGNLERECNEELCNYEEAREIFVDEDKTIAFWQEYSAKG   100

G  100  PTTRSDVNKEKIDVMGLLTGLIAAGVFLVVFGLLGYYLCITKCNRQPYQG   149
        |||:|| |:|||||||||||||||||||:|||||||||||||||| :  
H  101  PTTKSDGNREKIDVMGLLTGLIAAGVFLVIFGLLGYYLCITKCNRLQHPC   150

G  150  SSAVYTRRTRHTPSIIFRTHEEAVLSP.SSSSEDAGLPSYEQAVALTRKH   198
        ||||| ||||:||||||:|||||||| ||||||||||||||||||||||
H  151  SSAVY.ERGRHTPSIIFRRPEEAALSPLPPSVEDAGLPSYEQAVALTRKH   199

G  199  SVSPPPPYPGPAKGFRVFKKSMSLPSH                         225
        |||||||||| :||||||||||||||
H  200  SVSPPPPYPGHTKGFRVFKKSMSLPSH                         226
```

Fig. 46

```
C   MHLPPAAAVGLL-LLLLPPPARVASRKPTMCQRCRALVDKFNQGMANTARKNFGGGNTAWEEKSLSKYEF
            :: :::::: :::::::::::::::::::::::::::::::::::::::::
H   MRLPRRAALGLLPLLLLLLPPAPEAAKKPTPCHRCRGLVDKFNQGMVDTAKKNFGGGNTAWEEKTLSKYES
              10        20        30        40        50        60        70
                                                                    70

C   SEIRLLEIMEGLCDSNDFECNQLLEQHEEQLEAWWQTLKKECPNLFEWFCVHTLKACCLPGTYGPDCQEC
    ::::::::: :::: ::::: :: :::::: :::::::: :::::: :::: :::::: ::::: ::
H   SEIRLLEILEGLCESSDFECNQMLEAQEEHLEAWWLQLKSEYPDLFEWFCVKTLKVCCSPGTYGPDCLAC
    80        90       100       110       120       130       140
              150       160       170       180       190       200       210

C   QGGSQRPCSGNGHCDGDGSRQGDGSCQCHVGYKGPLCIDCMDGYFSLLRNETHSFCTACDESCKTCSGPT
    ::::::::::::: ::::::::::: ::::::::::: :::::::: :::::::: :::::::::: :
H   QGGSQRPCSGNGHCSGDGSRQGDGSCRCHMGYQGPLCTDCMDGYFSSLRNETHSICTACDESCKTCSGLT
    150       160       170       180       190       200       210
              220       230       240       250       260       270

C   NKGCVECECEVGWTRVEDACVDVDECAAETPPCSNVQYCENVNGSYTCEECDSTCVGCTGKGPANCKECISG
    :::::: ::::: :: ::::::::::: ::::: :::::: :::::::::::: ::::: :::::::::
H   NRDCGECEVGWVLDEGACVDVDECAAEPPPCSAAQFCKNANGSYTCEECDSSCVGCTGEGPGNCKECISG
    220       230       240       250       260       270       280
              290       300       310       320       330       340

C   YSKQKGECADIDECSLETKVCKKENENCYNTPGSFVCVCVPDGFEETEDACVPPAEAEATEGESPTQLPSR
    :::: ::: :::::: :::::::::::::: :::: :: :::::: ::      ::
H   YAREHGQCADVDECSLAEKTCVRKNENCYNTPGSYVCVCPDGFEETEDACVPPAEAEATEGESPTQLPSR
    290       300       310       320       330       340       350

C   P--
H   EDL
```

Fig. 49

```
C  --GTAGCCGGG--GGAACGGC-CGGC-----GCGCTTG-----CCGGTGGGCGGAGGCGAGACT--CCACA
    ..  ::   .  :::::::    :::    ..  ::        :::: :  :::::::::::::    :::::
H  ACGCGTCCGCACANGGCCGGCCGGCGGTGGGCGGGTGGGCGGAGCCGGGAGGCCGAGCAGCACGGCCGCA
               10        20        30        40        50        60        70
                     10        20        30        40        50        60        70

C  G----CAGTT-CTC-TGCCG-GTCG-CCCGCGAGTGC-ACCCGGCCATGCACCTGCCGC-CCGCTGCCGCAG
    :       :::::  :::  :::::  :::  :  ::::::: :::::::::::::::::::   ::::::::
H  GGACCTGGAGCTCCGGCTGCTCTTCCCCGC-AGCGCTACCCGCCATGCACCCGCTCCGCCCCG--GGCCGCGC
               80        90       100       110       120       130
                     80        90       100       110       120       130

C  TCGGGGCT---GCTACTGCTGCTGCTGCTGCCGCTCCCCCGGAAGCCGACAATGTGCCA
    :::::::    ::::::::::::::::::::::::::: :: :::::::::::::::::
H  TGGGGCTCCTGCGCTTCTGCCGCTTCTGCTGCTGCCGCCCCGGAGGCCGCCAAGAAGCCGACGACCCCTGCCA
              140       150       160       170       180       190       200
                    140       150       160       170       180

C  GAGGTGCCGGGGCTGGTGGTGGACAAGTTCAACCAGGGGATGGCCAACACGGCCAGGAAGAATTTCGGCGGC
    :::::::::::::::::::::::::::::  ::::::::::::::::   :::::::::::::::::::::
H  GAGGTGCCGGGGCTGGTGGTGGACAAGTTTAACCAGGGGATGGTGGACACCCGCAAAGAAGAACTTTGGCGGC
              210       220       230       240       250       260       270
                    210       220       230       240       250
```

Fig. 50A

```
              260         270         280         290         300         310         320
C  GGCAACACGGCGTGGGAGGAGAAGAGTCTGTCCAAGTACGAATTCAGTGAGATTCGGCTCCTGGAGATTA
   :: :::::::: ::::::::::: :: ::::::::::::::: :::::::::::: :::::::::::
H  GGGAACACGGCTTGGGAGGAGAAAGACGCTGTCCAAGTACGAGTCCAGCGAGATTCGCCTGCTGGAGATCC
         280         290         300         310         320         330         340

330         340         350         360         370         380         390
C  TGGAGGGCCTGTGTGTGACAGCAACGACTTTGAATGCAACCAACT-CTTGGAACAGCATGAGGAGCAGCTAG
   :::::::::::: :: :: :::::: :::::::::::::::::: :: :::::: ::::::::::::: :
H  TGGAGGGGCTGTGCGAGCTGCAGCAACGACTTCGAATGCGACTTCCGAATGCTAGAGGC-GCAGGAGCACCTGG
         350         360         370         380         390         400         410

400         410         420         430         440         450         460
C  AGGCCTGGTGGCAGACACTGAAAGAAGGAGTGCCCTAACCTATTTGAGTGGTTCTGTGTACACACTGAA
   :::::::::::::::::::::: :::::::: ::: :::::::: :::::: ::::::::::::::::
H  AGGCCTGGTGGCTGCAGTGGCGAATATCCTGACTTATTCGAGTGTGTTTTTGTGTGAAGACACTGAA
         420         430         440         450         460         470         480

470         480         490         500         510         520         530
C  AGCATGCTGTCTTCCAGGCACCTATGGGCCAGACTGTCAGGAATGCCAGGGTGGGTCTCAGAGGCCTTGT
   :: :::: ::::::::::: :: :: :: ::::::: :::: :::::::::::::::::::::::: :
H  AGTGTGCTGCTCTCCAGGAACCTACGGTCCCGACTGTCTCGCATGCCAGGCGGATCCCAGAGGCCCTGC
         490         500         510         520         530         540         550
```

Fig. 50B

```
       540         550         560         570         580         590         600
C AGCGGGAATGGCCACTGCCAGCGGAGATGGCAGCAGAGACAGGGCGACGGGTCCTGCCAGTGTCACGTAGGAT
  :: ::::::::::::::::::::::::::::::::::::::::: :: :::::::::::::::::::::::::
H AGCGGGAATGGCCACTGCCAGCGGAGATGGGAGCAGAGACAGGGCGACAGGGTCCTGCCGGTGCCACATGGGT
       560         570         580         590         600         610         620

610         620         630         640         650         660         670
C ACAAGGGGCCGCTGTGTATCGACTGCATGGATGGCTACTTCAGCTTGCTGAGGAACGAGACCCACAGCTT
  :: ::: :::::::::::::::::::::::::::::::::::::::::::::  : ::::::::::::::
H ACCAGGGGCCCGCTGTGCACTGCATGGACGGCTACTTCAGCTCGCTCCGGAACGAGACCCACAGCAT
       630         640         650         660         670         680         690

680         690         700         710         720         730         740
C CTGCACAGCCTGTGATGAGTCCTGCAAGACATGCTCAGGTCCAACAACAAAGGCTGTGTGGAGTGTGCGAA
  :::::::::::::::::::::::::::::::: : :  ::: ::  ::::: :::::::::::::::::::
H CTGCACAGCCTGTGACGAGTCCTGCAAGACGTGCTCCGGCCCTGACCAACAGAGACTGCGGGCGAGTGTGAA
       700         710         720         730         740         750         760

750         760         770         780         790         800         810
C GTGGGCTGGACACGTGCTGGAGGATGCCTGTGTGTGGAGGGCGCCGAGGGCGACGAGGTGTGCAGCAGAGACCCCACCCTGCA
  :::::::::::::::::: :: :::::::::::::::::::: :: ::::::::::::::::::::::::::
H GTGGGCTGGGGTGCTGGATGTGTGGATGTGGACGAGGTGTGCGGCCCGAGCCCGAGCCGGCCCCTCCCTGCA
       770         780         790         800         810         820         830
```

Fig. 50C

```
              820         830         840         850         860         870         880
C  GCAATGTACAGTACTGTGAAAATGTCAACGGCTCCTACACACATGTGAAGAGAGTGTGATTCTACCTGTGTGGG
   :::  :: :::::::::: ::::::: :::::::::::::::: :: :::::::::: :: :::::::::::
H  GCGCTGCGCAGTTCTGTAAGAACGCCAACGGCTCCTACACGTGCGAAGAGTGTGACTGTGACTCCAGCTGTGTGGG
         840         850         860         870         880         890         900

890         900         910         920         930         940         950
C  CTGCACAGGAAAAGGCCCAGCCAATTGTAAAGAGTGTATCTCTGGCTACAGCAAGCAGAAAGGAGAGTGT
   :::::::::  :::::: ::::::::::::::::::::::::::::::::  :::::::::  :: :::
H  CTGCACAGGGGAAGGCCCAGGAAACTGTAAAGAGTGTATCTCTGGCTACGGCGAGGAGCACGGACACAGTGT
         910         920         930         940         950         960         970

960         970         980         990        1000        1010        1020
C  GCAGATATAGATGAATGCTCATTAGAACAAAGGTTGTAAGAAGAAAATGAGAACTGCTACAATACTC
   :::::: :: :::::::  :::::: :::::::::: :::::::::::::: :::::::::::::::
H  GCAGATGTGGACGAGTGCTCCTACTAGCAGAAAAACCTGTGAGGAAAACGAAAAACTGCTACAATACTC
         980         990        1000        1010        1020        1030        1040

1030        1040        1050        1060        1070        1080        1090
C  CAGGGAGCTTTGTCTGCGTGTGTCCGGAAGGTTTCCGAAGGCTTCCTGACGGCTTCGAAGATGCTTGTGTACAGACAGCAG
   :::::::::: ::::::: :::::::  :::: :::::::::::::::::::: ::::::::: :::::::::::::::
H  CAGGGAGCTACGTCTGTGTGTGTGTCCTGTGTGACAGGGCTTCGAAGAA-ACGGAAGAGATGCCTGTGCCGGCCAG
        1050        1060        1070        1080        1090        1100        1110
```

Fig. 50D

```
          1100       1110       1120       1130       1140       1150
C AAGGCGAAGTGGCAGAGGAAAGT--CCC-ACACAGCCCACCCCTCCCATGAGGATTTGTGACGGGCATCCAG
  :::  ::::::::::   ::::: ::: ::::::::: ::::::::  :::::::::::  ::::: :::
H AGGCTGAAGCCACAGAAGGAGAAAGCCCGACACAGCTGCCCCTCCCGGAAGA-----------CCTG
          1120       1130       1140       1150       1160       1170
          1160       1170       1180       1190       1200       1210       1220
C GTTCAGAAGCTGGACTCTCACCCTTTTAAGTTATTGAGAGGACATCCTATAGAAAATGTGGCCCATGGAC
  ::   :::  ::::::: :::::::   :: :::::  :::::   :::::::::::::::::::   
H --TAATGTGCCGGACTT--ACCCTTTAAATTATTCAGAAGGATGTCCCGTGGAAAATGTGGCCCTGAGGA
        1180         1190       1200       1210       1220       1230

1230       1240       1250       1260       1270       1280       1290
C ATCAACCCCATTTCTCCCAGGAAGTTTTGG-AGGAAGAAGCTGCTGCTTTGAAACAGTAGATACTCACTT
    :  ::::::::: :: :::::::: ::: ::::::::::::::: ::::::::::::::::::: ::
H TGCCGTGTCTC----CTGCAGTGGACAGCGGGGGCGGGGAGAGGCTGCCTGCTCTCTAACGGTTGATTCTCATTT
        1240       1250       1260       1270       1280       1290       1300
          1300       1310       1320       1330       1340       1350       1360
C GGCCCTTTAAAACGCTGCATTTCTTGGTGGTTCTTGGTTCTTAAACAGATTCGTATATTTTGATACTGTTCTTTATA
  ::::: :::::: ::::::::::::::::: :::::::::::::::::: ::::::::::::::::: :::::
H GTCCCTTAAACA-GCTGCATTTCTTGGTGGTTGTTCTTAAACAGACTTGTATATTTTGATACAGTTCTTTGTA
        1310       1320       1330       1340       1350       1360       1370
          1370       1380       1390
C ATAAAATTGATCATTGAAGGTCACCAGGAA-------------CA--------
  ::::::::: ::::: ::::: ::::::::              ::
H ATAAAATTGACCATTGTAGGTAATCAAAAAAAAAAAAAAAAAAAAGGGCGGCCGCTAGAC
        1380       1390       1400       1410       1420       1430
```

Fig. 50E

```
              10        20        30        40        50        60        70
332 MAQLFLPLLAALVLAQAPAALADVLEGDSSEDRAFRVRIAGDAPLQGVLGGALTIPCHVHYLRPPPSRRA
    ::::::::::::::::::::::::::::::::::::::::::::::::::::::::::::::::::::::
BEF MAQLFLPLLAALVLAQAPAALADVLEGDSSEDRAFRVRIAGDAPLQGVLGGALTIPCHVHYLRPPPSRRA
              10        20        30        40        50        60        70

80        90       100       110       120       130       140
332 VLGSPRVKWTFLSRGREAEVLVARGVRVKVNEAYRFRVALPAYPASLTDVSLALSELRPNDSGIYRCEVQ
    ::::::::::::::::::::::::::::::::::::::::::::::::::::::::::::::::::::::
BEF VLGSPRVKWTFLSRGREAEVLVARGVRVKVNEAYRFRVALPAYPASLTDVSLALSELRPNDSGIYRCEVQ
              80        90       100       110       120       130       140

150       160       170       180       190       200       210
332 HGIDDSSDAVEVKVKGVVFLYREGSARYAFSFSGAQEACARIGAHIATPEQLYAAYLGGYEQCDAGWLSD
    :::::::::::                                                         :.
BEF HGIDDSSDAVE---------------------------------------------------------SS
             150

220       230       240       250       260       270       280
332 QTVRYPIQTPREACYGDMDGFPGVRNYGVVDPDDLYDVYCYAEDLNGELFLGDPPEKLTLEEARAYCQER
    :  :::::::::::::::::::::::::::::::::::::::::::::::::::::::::::::::::::
BEF Q--RYPIQTPREACYGDMDGFPGVRNYGVVDPDDLYDVYCYAEDLNGELFLGDPPEKLTLEEARAYCQER
            160       170       180       190       200       210       220

290       300       310       320       330       340       350
332 GAEIATTGQLYAAWDGGLDHCSPGWLADGSVRYPIVTPSQRCGGGLPGVKTLFLFPNQTGFPNKHSRFNV
    ::::::::::::::::::::::::::::::::::::::::::::::::::::::::::::::::::::::
BEF GAEIATTGQLYAAWDGGLDHCSPGWLADGSVRYPIVTPSQRCGGGLPGVKTLFLFPNQTGFPNKHSRFNV
            230       240       250       260       270       280       290
```

Fig. 52A

```
                 360          370          380          390          400          410
332  YCFRDSAQP-SAIPEASNPASDGLEAIVTVTETLEELQLPQEATESESRGAIYSIPIMEDGGGSS
     ::::::::: :::::::::: ::::::::::::::::::::::::::::::::::::::::::::
BEF  YCFRDSAQLLPSLRPPTQPPTQL--DGLEAIVTVTETLEELQLPQEATESESRGAIYSIPIMEDGGGSS
                 300          310          320          330          340          350

420          430          440          450          460          470          480
332  TPEDPAEAPRTLLEFETQSMVPPTGFSEEEGKALEEEEKYEDEEEKEEEEEEVEDEALWANPSELSSP
     ::::::::::::::::::::::::::::::::::::::::::::::::::::::::::::::::::::
BEF  TPEDPAEAPRTLLEFETQSMVPPTGFSEEEGKALEEEEKYEDEEEKEEEEEEVEDEALWANPSELSSP
       360          370          380          390          400          410          420

490          500          510          520          530          540          550
332  GPEASLPTEPAAQEKSLSQAPARAVLQPGASPLPDGESEASRPPRVHGPPTETLPTPRERNLASPSPSTL
     :::::::::::: ::::::::::::::::::::::::::::::::::::::::::::::::::::::::
BEF  GPEASLPTEPAAQEESLSQAPARAVLQPGASPLPDGESEASRPPRVHGPPTETLPTPRERNLASPSPSTL
       430          440          450          460          470          480          490

560          570          580          590          600          610          620
332  VEAREVGEATGGPELSGVPRGESEETGSSEGAPSLLPATRAPEGTRELEAPSEDNSGRTAPAGTSVQAQP
     :::::::::::::::::::::::                                 ::
BEF  VEAREVGEATGGPELSGVPRG---------------------------GAR-------------TQ-
       500          510          520

630          640          650          660          670
332  VLPTDSASRGGVAVVPASGNSAQGSTALSILLLFFPLQLWVT
                                       ::
BEF  --------------------------------FAL------
```

Fig. 52B

```
                                      10         20         30         40         50         60
M MIPLLLSLLAALVLTQAPAALADDLKEDSSEDRAFRVRI-GAAQLRGVLGGALAIPCHVHLRPPRSRRA
  ::...::::::::..::::::::::::::::::::::::::::::::::::::::::::::::::::::::
H MAQLFLPLLAALVLAQAPAALADVLEGDSSEDRAFRVRIAGDAPLQGVLGGALTIPCHVHYLRPPPSRRA
                                      10         20         30         40         50         60         70

70         80         90        100        110        120        130
M APGFPRVKWTFLSGDREVEVLVARGLRVKVNEAYRFRVALPAYPASLTDVSLVLSELRPNDSGVYRCEVQ
  .:::::::::::.::::::::::.::::::::::::::::::::::::::::::::::::::::::::::
H VLGSPRVKWTFLSRGREAEVLVARGVRVKVNEAYRFRVALPAYPASLTDVSLALSELRPNDSGIYRCEVQ
                80         90        100        110        120        130        140

140        150        160        170        180        190        200
M HGIDDSSDAVEVKVKGVVFLYREGSARYAFSFAGAQEACARIGARIATPEQLYAAYLGGYEQCDAGWLSD
  ::::::::::::::::::::::::::::::::.:::::::::::::::::::::::::::::::::::::
H HGIDDSSDAVEVKVKGVVFLYREGSARYAFSFSGAQEACARIGAHIATPEQLYAAYLGGYEQCDAGWLSD
                150        160        170        180        190        200        210

210        220        230        240        250        260        270
M QTVRYPIQNPREACSGDMDGYPGVRNYGVVGPDDLYDVYCYAEDLNGELFLGAPPSKLTWEEARDYCLER
  :::::::::.:::::::::::.::::::::::::::::::::::::::::::::..:::::::::::::
H QTVRYPIQTPREACYGDMDGFPGVRNYGVVDPDDLYDVYCYAEDLNGELFLGDPPEKLTLEEARAYCQER
                220        230        240        250        260        270        280

280        290        300        310        320        330        340
M GAQIASTGQLYAAWNGGLDRCSPGWLADGSVRYPIITPSQRCGGGLPGVKTLFLFPNQTGFPSKQNRFNV
  ::.:::::::::::::.:::::::::::::::::::.:::::::::::::::::::::::::::::::::
H GAEIATTGQLYAAWDGGLDHCSPGWLADGSVRYPIVTPSQRCGGGLPGVKTLFLFPNQTGFPNKHSRFNV
                290        300        310        320        330        340        350
```

Fig. 53A

```
             360         370        380        390        400        410
350
  M YCFRDSAHPSASSEASSPAS----DGLEAIVTVTEKLEELQLPQEAMESESRGAIYSIPISEDGGGSST
    :::::::::::::::::::    ::::::::::::::::::::::::::::::::::::::::::::
  H YCFRDSAQPSAIPEASNPASDGLEAIVTVTETLEELQLPQEATESESRGAIYSIPIMEDGGGSST
             360         370        380        390        400       410        420

420        430        440        450        460        470
  M PEDPAEAPRTPLESETQSIAPPTESSEEGVALEEEERFKDLEALEEEKEQED----LWVWPRELSSP-
    :::::::::::::::::::::::::::::::::::::::::::::::::::    ::::::::::
  H PEDPAEAPRTLLEFETQSMVPPTGFSEEEGKALEEEEKYEDEEEKEEEEEVEDEALWAWPSELSSPG
              430        440        450        460        470        480       490

480        490        500        510        520        530
  M ----LPTGSET-EHSLSQVSPPAQAVLQLDASPSPG------PPRFRGPPAETLLPPREWS-ATSTPGG
         :::::  :::::::::::::::::::::::::      :::::::::::::::::: :::::::
  H PEASLPTEPAAQEKSLSQ--APARAVLQPGASPLPDGESEASRPPRVHGPPTETLPTPRERNLASPSPST
              500        510        520        530        540        550       600

540        550        560        570        580        590
  M ----AREVGGETGSPELSGVPR-ESEEAGSSSLEDGPSLLPATWAPVGPRELETPSEEKSGRTVLAGTSVQ
         :::::::::::::::::: ::::: ::::::::::::::::::::::::::::::::::::::::
  H LVEAREVGEATGGPELSGVPRGESEETGSS--EGAPSLLPATRAPEGTRELEAPSEDNSGRTAPAGTSVQ
              570        580        590        600        610        620

610        620        630        640        650        660       670
  M AQPVLPTDSASHGGVAVAPSSGDCIPSPCHNGGTCLEEKEGFRCLCLPGYGGDLCDVGLHFCSPGWEAFQ
    ::::::::::::: :::: ::::                  :      :::::
  H AQPVLPTDSASRGGVAVVPASGNSAQ-----GSTAL-----------------------------
              630        640        650
```

Fig. 53B

```
         680        690        700        710        720        730        740
M  GACYKHFSTRRSWEEAESQCRALGAHLTSICTPEEQDFVNDRYREYQWIGLNDRTIEGDFLWSDGAPLLY
                                  :                  :  :          :  :
H  ---------------------------SI----------L-------------------------LLF
                                          660

750        760        770        780        790        800        810
M  ENWNPGQQPDSYFLSGENCVVMVWHDQGQWSDVPCNYHLSYTCKMGLVSCGPPPQLPLAQIFGRPRLRYAV
            :                                                 : :
H  ---------F---------------------------------------------PLQ-----------

820        830        840        850        860        870        880
M  DTVLRYRCRDGLAQRNLPLIRCQENGLWEAPQISCVPRRPGRALRSMDAPEGPRGQLSRHRKAPLTPPSS
               :  :
H  ---LWVT-----------------------------------------------------------
             670

```
H  GTCG-ACCCA-CG------CGTCC----------GTCCTGCGGCCCCAGCCTCTCCTCACGCTCGCGCAGTC
           ::::  ::        ::   ::    ::::  ::  :::::::::::::::::::::::  ::
M  GAGGCTCCCGGCGAGCTGGCGCCCCCTGTCTGGGTCCCGCGCCCGGCC-CTGCTCGGCCCGGCGCA-TC
             10            20           30        40         50          60

H  TCCGCCGCAGTCTCAG-CTGCAGGACTGAGCCGTGCACCCGGAGGAGACCCCGGAGGAGGCGA
       :::::::::::::::::  ::::::::::::: :  :::  :: ::::: :::::::::::::
M  GC-GCCGCAGTCTCGTCGGTCTGGTCTGCGGGCTGCGGGGACGTGACGGCCGTGCGCGGAGGC
         70          80          90         100         110        120

H  CAAACTTCGCAGTGCCGCGACCCCAGCCTGGGTAGCCTGCAGCATGGCCCAGCTGTTCCTGCCC
      ::                   :::  ::::     :::   :::::::::::::::::::::
M  -GTTCTTC--------CATC----------AGTG---TGCAGAATGATACCACTGCTTCTGTCC
   130           140             150            160          170

H  CTGCTGGCAGCCCTGGTCCTGCTGGCCCAGCTCCTGCCAGCTTTAGCAGATGTTCTGGAAGGAGACAGCTCAG
     :::::::::::::::::::::::::  :::::::::::::::::::: ::: :: ::::::::::::::
M  CTGCTGGCCGCTCTGGTCCTGCTGGGTCCAAGCCCCTGACCCAAGCCCCTGCCCCTCGCTGATGACCTGAAAGAAGACAGCTCGG
       180         190          200        210         220         230         240

H  AGGACCGCGCTTTTCGCTGCGCATGCG-GTGC--CGGCAGCTGCCATCG-GTGC--CGGCAGCTGCGGGGGCGTGCCGCGGCGCCCTCAC
          ::::::::   ::::::::::::: ::::  ::::::::::::::                :::  ::::::::::::::::
M  AGGATCGAGCCTTCCGCCGTGCCGTCATCG-GTGC--CGGCAGCTGCGGGGGCGTGCTGCCGCGGCGCCCTGGC
         250         260         270          280          290         300
```

Fig. 54A

```
H CATCCCTTGCCACGTCCACTACCTGCGGGCCACCGCCGAGCCGCCGGGCTGTGCTGGGCTCTCCGGGGTC
  :::::::::::::::::::::::::::::::       :::::  :::::::::::::::::::: : ::
M CATCCCATGCCACGTCCACCACCTGCGCCGCCGCCGCGCCGCCGGGCCGCGCCGGGCTTTCCCGGGTC
  310       320       330       340       350       360       370

H AAGTGGACTTTCCTGTCCCGGGGCCGGGAGGCAGAGGTGCTGGTGGCGCGGGAGTGCGCGTCAAGGTGA
  ::::::::: ::: ::::::::::::::::::::::::::  :::::::::::::::::::::::::::
M AAGTGGACCTTCCTGTCCCGGGGCCGGGAGGTAGAGGTTCTGGTGGCTCGGGCTGCCGCGTCAAGGTAA
  380       390       400       410       420       430       440

H ACGAGGCCTACCGGTTCCGCGTGGCACTGCCTGCTGCCTGCGTACCCAGCGTCGCTCACCGACGTCTCCCTGGCGCT
  ::::: :::::::::::::::::::::::::::::::  : :::::::::::: :::::::::::::::  :  :
M ACGAAGCCTACCGGTTCCGCGTGGCTGTGCCTGCCTGCCTGCGCATCGCTCACGCCCCGCTCACGCGGATGTGTCTAGTATT
  450       460       470       480       490       500       510

H GAGCGAGCTGCGCCCCAAGACTGCTGCAGGTCTATCGCTGTGAGGTCCAGCACGGGCATCGATGACAGAGC
  ::::::::::::::::  :::::: :: :: ::::::::::::::::::::::::::::::::::::::::
M GAGCGAACTGCGCCCAATGATTCCGGGGTCTATCGCTGTGAGGTCCAGCACGGTATCGCGACACAGCAGT
  520       530       540       550       560       570       580

H GACGCTGTGGAGGTCAAAGGTCAAGGGGTCGTCTTTCTCTACCGAGAGGGCTCTGCCCCGCTATGCTTTCT
  ::::::::::::::::::::::::::::::::::::::::::::::::::::::::::::::::::::::
M GATGCTGTGGAGGTCAAAGGTCAAGGGGTCGTCTTCCTCTACAGAGAGGGCTCTGCGCCGCTATGCTTTCT
  590       600       610       620       630       640       650
```

Fig. 54B

```
               690       700       710       720       730       740       750
H  CCTTTCTGGGGCCCAGGAGGCCTGTGCCCGCATTGGAGCCCACATGCCACCCCGGAGCAGCTCTATGC
   :::::      ::::::::::::::::::::::::: ::::::::::::::::::::::::::::::
M  CCTTCGCTGGAGCCCAGGAAGCCTGCCGCTCGCATAGGAGCCCACCCCGGAGCAGCTCTATGC
               660       670       680       690       700       710       720

760       770       780       790       800       810       820
H  CGCCTACCTTGGGCTATGAGCAATGTGATGCTGGCTGGCTGTGTCGGATCAGACCGTGAGGTATCCCATC
   ::::::::::::::::::::::::::::::::::: ::::::::::::::::::::::::::::::::::
M  TGCCTACCTTCGGCTATGAGCAGTGTGATGCTGGCTGTGTCCGACCAAACTGTGAGGTACCCCATC
               730       740       750       760       770       780       790

830       840       850       860       870       880       890
H  CAGACCCCACGAGAGGCCTGTTACGGAGACATGGATGGCTTCCCCGGGTCCGGAACTATGGTGTGGTGG
   :::::::::::::::::::::: ::::::::::::::::::::::::::::::::::::::::::::::
M  CAGAACCCCACGAGAGGCCTGCTGCTCTGGAGACATGGATGGCTATCCTGGCGTGCGGAACTACGGAGTGGTGG
               800       810       820       830       840       850       860

900       910       920       930       940       950       960
H  ACCCGGATGACCTCTATGATGTGTACTGTTATGCTGAAGACCTAAATGGAGAACTGTTCCTGGGTGACCC
   :::::::::::::::::::::::::::::::::::::::::::::::::::::::::::::::::::::
M  GTCCTGATGATCTCTATGATGTCTACTGTTATGCCGAAGACCTAAATGGAGAACTGTTCCTAGGCGCCCC
               870       880       890       900       910       920       930

970       980       990      1000      1010      1020      1030
H  TCCAGAGAAGCTGACATTGGAGGAAGCACGGGCGTACTGCCAGGAGCGGGGTGCAGAGATTGCCACCACG
   :::: ::::::::::::::::::::::::::::::::::::::::: :::::::::::::: :::::::
M  TCCCAGCAAGCTGACATGGGAGGAGGCTCGGGAGGCTGTCTGAACGTGGTGTGCACAGATCGCGTAGCACA
               940       950       960       970       980       990      1000
```

Fig. 54C

```
            1040       1050       1060       1070       1080       1090       1100
H  GGCCAACTGTATGCAGCCTGGGATGGTGGCCTGGACCACTGCAGCCCCAGGGTGGCTAGCTGATGGCAGTG
   ::::: :: ::  : ::::: ::::  : ::::::::::: : :::::::::::::  ::::::::::: ::
M  GGCCAGCTGTACGCAGCCTGGGATGGTGGCCTGGACAGATGTAGCCCCTGGCCCTGGCTGGCTGATGGCAGCG
   1010       1020       1030       1040       1050       1060       1070

1110       1120       1130       1140       1150       1160       1170
H  TGCGCTACCCCATCGTCACACCCCAGCGCTGTGTGGGGGCTTGCCTGTGTCAAGACTCTCTTCCT
   :::::: :::: ::::: :: ::::::::: ::::::: ::: ::: :::::::::::: :::::
M  TGCGCTATCCCATCATCACACCCCAGCCCAACGCTGTGGGGGCGGCCGCCTGCCAGGAGTCAAGACCCCTCTTCCT
   1080       1090       1100       1110       1120       1130       1140

1180       1190       1200       1210       1220       1230       1240
H  CTTCCCCAACCAGACTGGCTTCCCCAATAAGCACAGCCGCTTCAACGTCTACTGCTTCCGAGACTCGGCC
   :: :::::::::::::::::::::::: ::  :::::::::::: :: ::::::: :::::::::: ::
M  CTTTCCCAACCAGACTGGCTTCCCCAGCAAGCAAGAGCCAGAGAACCGCTTCAATGTCTACTGCTTCCGAGACTCTGCC
   1150       1160       1170       1180       1190       1200       1210

1250       1260       1270       1280       1290       1300       1310
H  CAGCCTTCTGCCATCCCTGAGGCCTCCAACCCAGCCCTCCAGCCCCAGCCTC------------AGATGGACTAGAGGCTATCG
   ::::::::: ::  :::: :: :::::: ::::::::::  :: ::::::::            :::::: ::  :: :: :
M  CATCCCCTCTGCTTCCTCTGAGGCCTCTGAGGCCTCTAGCCCTCTAGCCCTCTAGCCCTC--------AGATGGACTTGAGGCCATTG
   1220       1230       1240       1250       1260       1270

1320       1330       1340       1350       1360       1370       1380
H  TCACAGTGACAGAGACCCTGGAGGAACTGCAGCTGCCCTCAGGAGCCACAGAGTGAATCCCGTGGGC
   :::::::::::::  ::::::  :::::::::::::::::::::: ::::::::  :::: :::::
M  TCACAGTGACAGAAAAGCTGGAGGAACTGCAGCTGCCCTCAGGAAGCGATGGAGAGCGAGTCTGTGGGGC
   1280       1290       1300       1310       1320       1330       1340
```

Fig. 54D

```
                  1390       1400       1410       1420       1430       1440       1450
H CATCTACTCCCATCCCCATCATGGAGGACGGAGGAGGTGGAAGCTCCACTCCAGAAGACCCAGCAGAGGCC
  ::::::::::::::::::::::: :::::::::::::::::::::::::::::::::::::::::::::::::::
M CATCTACTCCCATCCCCATCTCCAGAAGATGGGGAGGAGGAAGCTCCACCCCAGAAGACCCAGCAGAGGCC
      1350       1360       1370       1380       1390       1400       1410

1460       1470       1480       1490       1500       1510       1520
H CCTAGGACGCTCCTAGAATTTGAAACACAATCCATGGTACCGCCCACGGGGTTCTCAGAAGAGGAAGGTA
  ::::::::: : :::::::::::::::::::: ::::::::::::::::::::::::::::::::::: :
M CCCAGGAGACTCCGCTAGAATCGGAAATCCAATCCAATCCTACCACCTGCACCACCTACCGAGTCCTCAGAAGAGGAAGGCG
  1420       1430       1440       1450       1460       1470       1480

1530       1540       1550       1560       1570       1580       1590
H AGGCATTGGAGGAAGAAGAGAAATATGAAGATGAAGAAGAGGAAGAGGAAGAAGAGGAGGAGGT
  :::: :::::::::::::::::::::::::: ::::::
M TAGCCCCTGGAGGAAGAAGAAAGATTCAAAGAC------------TTGGAGGCTCTGGAGGAAGAAGAAGGAGCA
  1490       1500       1510       1520       1530       1540

1600       1610       1620       1630       1640       1650       1660
H GGAGGATGAGGCTCTGTGGGCATGGCCCAGCGCTCAGCAGAGCCCGGGCCCTGAGGCCCTCTCCCCACT
  :::::      : ::::::::::::::::::::::::::::::::::::::::::           :::::: :
M GGAGGA------C-CTGTGGGTGTGGCCCAGAGAGCTCAGCAGCCC-----------------TCTCCCTACT
  1550       1560       1570       1580                 1590

1670       1680       1690       1700       1710       1720
H GAGCCAGCAGCCCAGGAGCCCAGGAGAAGTCACTCTCCCAGG------CGCCAGCAAGGCAGTCCTGCAGCCTGGTG
  :: ::: :::::: ::::::::::::::::::::::::::::::::        :::::::::::::::::: :: ::
M GGCTCAGAAAAC---AGAGCATTCACTCTCCCCAGGTGTCCCCAGGCCCAGGCCCAGGCAGTTCTACAGCTGGATG
  1600       1610       1620       1630       1640       1650       1660
```

Fig. 54E

```
                1730      1740      1750      1760      1770      1780      1790
H CATCACCACTTCCTGATGGAGAGTCAGAAGCTTCCAGGCCTCCAAGGGTCCATGGACCACCACTGAGAC
  :  :::::::
M CGTCACCTTCTCTCCTG---------------------GGCCTCCAAGGTTCCGTGGACCGCCTGCAGAGAC
                1670                        1680      1690      1700      1710

1800      1810      1820      1830      1840      1850      1860
H TCTGCCCCACTCCCAGGGAGAGAACCTAGCATCCCCATCACCTTCCACTCTGGTTGAGGCAAGAGAGGTG
  :                                   :  :  :::
M TTTGCTCCCCCCCGAGGGAGTGGAGC----------GCCACATCTACT-CC----TGGT-GGGGCAAGAGAAGTA
           1720      1730                        1740              1750         1760   1770

1870      1880      1890      1900      1910      1920      1930
H GGGGAGGCAACTGGTGGTCCTGAGCTATCTGGGGTCCCTGAGGAGAGAGCGAGGAGACAGGAAGCTCC-
  : ::::::                                                                :
M GGGGGGGAAACTGGGAGCCCTGAGCTCTCTGGGGTTCCTGA---GAGAGCGAGGAGGCAGGGAGCTCCA
           1780      1790      1800                  1810              1820         1830

1940      1950      1960      1970      1980      1990      2000
H -----GAGGGTGCCCCTTCCCTGCTTCCAGCCACACGGGCCCCTGAGGGTACCAGGAGCTGGAGGCCCC
  :::::::
M GCTTGGAGGATGGCCCCTTCCCTTCCAGCCAGCTACACTGGGCCCCTGTGTGGGTCCCAGGGAGCTGGAGACCCC
           1840      1850      1860      1870      1880      1890      1900

2010      2020      2030      2040      2050      2060      2070
H CTCTGAAGATAATTCTGGAAGAACTGCCCCAGCAGGACCTCAGTGCAGGCCCAGCCCAGTGCTGCCCACT
  :::::::
M CTCAGAAGAGAAGTCTGGAAGAACTGTCCTGGCAGCACCTCAGTGCAGGCACCTCAGTGCCCAGCCCAGTGCTGCCCACC
           1910      1920      1930      1940      1950      1960      1970
```

Fig. 54F

```
            2080       2090       2100       2110       2120             2130
H GACAGCGCCAGCCGAGGTGGAGTGCCGTGTCCCCGCATCAGGTAATT------CTGCCCAAGGCTCA
  ::::: :::::::::::: ::::::::: ::::  :: :::  ::      ::::: ::: ::
M GACAGTGCCAGCCAGCCACGGTGGAGTGGAGTGGCTCGTGGCTCCCTCCCTCATCAGGTGACTGTATCCCCAGCCCCCTGCCACA
  1980       1990       2000       2010       2020       2030       2040

H A------C-TGC--------------------CCTCT--CTAT------CCTA-CT------CCT
  :      : ::::                   :::: :  ::  ::    :: ::      :::
M ATGGTGGGACATGCTTGAGGAGAGAAGGAGGGTTTCCGCTGCCTATGTTTGCCAGGCTATGGGGGACCT
  2050       2060       2070       2080       2090       2100       2110

2160       2170       2180       2190             2200
H TTTC------TTCCC---C-----CTGCAGCTCTGG------GTC--ACCTGA---CCTG----TAGTCCTTT
  ::::       ::::   :     ::::::::::::         ::     :     ::::   ::: :::::
M GTGCGATGTTGGCCTTCATTTCTGCAGCCCCTGGCTGGGATGCCCTTCCAGGGAGCCTGCTACAAGCACTTT
  2120       2130       2140       2150       2160       2170       2180

2210       2220       2230            
H AACCCAC-----------CA--TCA-TCCCAAACTCT--:--C-----CTGTCC-----TTT
  :::::::         :::   ::::  :::: ::: ::  :  :::::::::  ::
M TCCACACGAAGGAGTTGGGAGGAGCAGAAAGTCAGTGCCGAGCGCTAGGTGCTCATCTGACCAGCATCT
  2190       2200       2210       2220       2230       2240       2250

2260            2270
H GC-----CT----------TCATTCTCT--TACCC---ACC----TCTACCTATGGGT----CTC-------
  ::     ::          ::: ::  :   ::     :::    :::::  ::::::   :::
M GCACCCCTGAGGAGCAAGACTTTGTCAATGATCGATACCGGAGTACCAGTGATTGGGCTCAATGACAG
  2260       2270       2280       2290       2300       2310       2320
```

Fig. 54G

```
                         2280              2290              2300              2310              2320
H --CAATCTCGGATATCCAC-------- :::: :: ----CTTGTGG-GTATCTCAGCTCTCCGCGT-CTT-TACCCTGTG-AT
                       :::: ::        :: ::::: :                  : :: :::::::: ::
M GACCATCGAGGGTGACTTCTTGTGGTCAGATGGTCCCCTCTGCTCTATGAAAACTGGAACCCTGGGCAG
     2330              2340              2350              2360              2370              2380              2390

2330              2340              2350
H CC----CAGC-----CCCGCC---------ACTG----------------------ACCA---TCTGTGA----------
     :::: :                 : ::::               ::::            :::: :::::
M CCTGACAGCTACTTCCTGTCTCTGGGGAGAACTGTGTGGTCATGGTGTGGCATGACCAGGACAGTGGAGTG
     2400              2410              2420              2430              2440              2450              2460

2360              2370              2380                              2390
H ------CCCTTCC--CTGCCATTGGGCC---CTCCA------------------------CCTGTGG--CTCACACTCTC
       :::::::: :: ::::::::::                              :::::::  :: :::: ::::
M ATGTGCCCCTGCAACTACTACCATCTATCCTACACCTGCAAGATGGGGCTTGTGTCCTGTGGGCCCTC-CACCAC
     2470              2480              2490              2500              2510              2520              2530

2400              2410              2420              2430              2440              2450
H GCCAGCCCCA------CA-------GAGCATCCTCAG----GCCTCTCCAAGGGTCCTCATCACCTATTGCA
      ::::::::       ::                :::::::::           :: :::: ::::::: ::
M AGCTACCCCCTGGCTCAAATATTTGGTCGCCCCTCCGGCTGCGCCTACGCGGTGGATACTGTGCTTCGATATCG
     2540              2550              2560              2570              2580              2590              2600

2460                         2470              2480
H --GCCTT--CAGG-----GCTCGGC-----------CTATTTTCCACTAC----------TCC--
   :::   :: ::::          :: ::::::::
M ATGCCGAGACGGGCTGCTGGCTCAGCAGCGCAACCTGCCGCTGCCAGGAGAATGGGCTTTGGAGGCC
     2620              2630              2640              2650              2660              2670
```

Fig. 54H

```
            2490       2500       2510       2520       2530
H   CTTCA-TCCGCCTGTGTGCC-----GTCC---CCTTTAGCTGC-CTCCT-----------ATTGATCTC
    :: :::   ::::::::       :: :::      :::::  :::::           :: :: :::
M   CCTCAGATTTCCTGTGTACCCCGGAGGCCTGGCCGTGCTCTGCGCTCCATGGACGCCCCAGAAGACCAC
    2680       2690       2700       2710       2720       2730       2740

2540       2550       2560       2570       2580
H   AGGGA-AGC----------CTGGGAGTC-CC-TTCTCACC---CCTC-AACCTCCGGAGT-CCAGGAGAAC
    : : : :::          :::::: :: :: :::::::    :::: :: :::::::: ::::::::::
M   GGGGACAGCTCTCGAGGCACAGGAAGGCACCCGTTGACACCGCCCCTCCAGTCTCTAGGGAGCCTGGAAGAC
    2750       2760       2770       2780       2790       2800       2810

2590       2600       2610       2620       2630
H   CCGTACCCCCA-CAGAGCCTTAA-GCAACTACT-------TCT---------GTGAAGTATTT
    :::::: :::: :::::::: :: ::::::::        :::              :: :: ::: .
M   TGCTGCCCCCAGCAGGACAGGACCCCTCTCACATCAACTGCCAGTGCTCTTCCCCATGATAGGGGGTGAGA
    2820       2830       2840       2850       2860       2870       2880

2640                   2650
H   ----TTTGACTGT--TTCA---------TGGAAAACA----------------
    :   :: :::::   ::::          :::::: ::
M   GGGGTGGGACTGAAATTCAGAGGACAGCGCTCGAAGGGGTTTCTGGGAAAACACTTGGGTGGCTCCGCCCC
    2890       2900       2910       2920       2930       2940       2950

2660       2670                              2680
H   --------AGCCTTGGAAAT-------AAATCTCTATTAA----------------AC
            :::: :: ::::       :::::::::: ::                 ::
M   CTCACACAAGGGCCTCAGGTTTTACCCGGTAAGTCCCTAAGTGCCTCAACTGCCCTCTCATGTCAGCTGC
    2960       2970       2980       2990       3000       3010       3020
```

Fig. 54I

```
                                                                                2700
H  CGCTTTGT------------------------------AAC--------------------------CAAAAAAAAAAAAAAA
   : : :: ::                              : :                          :: : : : : :: : ::
M  CTCCTTGTCCCTCGATNTCGTNAGGGGACACTGTGCTATTCGATCTTGATTGTCGAAGAGTTTTTAGGAT
   3030        3040        3050        3060        3070        3080        3090

2710                                         2720       2730
H  AAA------------------------------AAAAAAAAGGGCGG---CC---------GC-----------
   : :                               :: :: : :: ::     ::          ::          .
M  GGAGTACCAGCAAAACCAGGTGGAAATAAAGTTGTCTGAACCCAAAGAAAAAAAA
   3100        3110        3120        3130        3140        3150
```

Fig. 54J

```
Hum.  MAPPAARLALLSAAALTLAARPAPSPGLGPGPECFTANGADYRGTQNWTALQGGKPCLFWNETFQHPYNT
      ::::::::::::::::::::::::::   :::::::::::::::: ::::::::::::::::::::::
Mur.  MAPPAARLALLSAAALTLAARPAPGPR--SGPECFTANGADYRGTQSWTALQGGKPCLFWNETFQHPYNT
              10        20        30        40        50        60        70

Hum.  LKYPNGEGGLGEHNYCRNPDGDVSPWCYVAEHEDGVYWKYCEIPACQMPGNLGCYKDHGNPPPLTGTSKT
      ::::::::::::::::::::::::::::::::::::::::::::::::::::::::::::::::::::
Mur.  LKYPNGEGGLGEHNYCRNPDGDVSPWCYVAEHEDGVYWKYCEIPACQMPGNLGCYKDHGNPPPLTGTSKT
              80        90       100       110       120       130       140

Hum.  SNKLTIQTCISFCRSQRFKFAGMESGYACFCGNNPDYWKYGEAASTECNSVCFGDHTQPCGGDGRIILFD
      ::::::::::::::::::::::::::::::::::::: ::::::::::::::::: ::::::::::::
Mur.  SNKLTIQTCISFCRSQRFKFAGMESGYACFCGNNPDYWKHGEAASTECNSVCFGDHTQPCGGDGRIILFD
             150       160       170       180       190       200       210

Hum.  TLVGACGGNYSAMSSVVYSPDFPDTYATGRVCYWTIRVPGASHIHFSFPLFDIRDSADMVELLDGYTHRV
      ::::::::::::  :::::::::::::::::::::::::::  ::::: :::::::::::::::::::
Mur.  TLVGACGGNYSAMAAVVYSPDFPDTYATGRVCYWTIRVPGASRIHFNFTLFDIRDSADMVELLDGYTHRV
             220       230       240       250       260       270       280
```

Fig. 55A

```
            290       300       310       320       330       340       350
Hum.  LARFHGRSRPPLSFNVSLDFVILYFFSDRINQAQGFAVLYQAVKEELPQERPAVNQTVAEVITEQANLSV
      ::  :::::::::::::::::::::::::::::::: :::::::: ::::::::::::::::::::::
Mur.  LVRLSGRSRPPLSFNVSLDFVILYFFSDRINQAQGFAVLYQATKEEPPQERPAVNQTLAEVITEQANLSV
            280       290       300       310       320       330       340

360       370       380       390       400       410       420
Hum.  SAARSSKVLYVITTSPSHPPQTVPGSNSWAPPMGAGSHRVEGWTVYGLATLLILTVTAIVAKILLHVTFK
      :::: ::::::::::::::::: ::::::      ::    :     :  ::  :  :
Mur.  SAAHSSKVLYVITTSPSHPPQTAQVAIPGHRQLGPTA---TEWKD-GLCTAWRPSSSSQSQQLSQRFFCM
            350       360       370       380       390       400       410

430       440       450       460       470
Hum.  SHRVPASGDLRDCHQPGTSGEIWSIFYKPSTSISIFKKKLKGQSQ-QDDRNPLVSD
      ::  :         :     :    :         ::    :
Mur.  SHLNLIESLHQETLGTVVSLGLLEISGPFSMNLPLQSPSLRRSSRVRVNKMTAIPS
            420       430       440       450       460       470
```

Fig. 55B

```
Hum.  MMLPQNSWHIDFGRCCHQNLFSAVVTCILLLNSCFLISSFNGTDLELRLVNGDGPCSGTVEVKFQGQWG
           10        20        30        40        50        60        70
      ::     ::       :: ::::::   :     ::    ::     ::   ::   ::  :  ::
WC1   MAL------GR------HLSLRGL----CVLLLGT--MVG---GQALELRLKDGVHRCEGRVEVKHQGEWG
                       10            20           30        40        50

Hum.  TVCDDGWNTTASTVVCKQLGCPFSFAMFRFGQAVTR-HGKIWLDDVSCYGNESALWECQH---REWGSHN
           80        90       100       110       120       130
      :: ::::   :       :: ::::          :     :    :     ::::
WC1   TVDGYRWTLKDASVVCRQLGCCGAAIG-FPGGAYFGPGLGPIWLLYTSCEGTESTVSDCEHSNIKDYRNDG
                       60        70        80        90       100       110

Hum.  CYHGEDVGVNCYGEANLGLRLVDGNNSCSGRVEVKFQERWGTICDDGWNLNTAAVVCRQLGCPSSFISSG
          140       150       160       170       180       190       200
      :   ::   :       ::   ::::     :       ::  ::         :::::::
WC1   YNHGRDAGVVCSG----FVRLAGGDGPCSGRVEVHSGEAWIPVSDGNFTLATAQIICAELGCKAVSVLG
         120       130           140       150       160       170       180

Hum.  VVNSPAVLRPIWLDDILCQGNELALWNCRHRGWGNHDCSHNEDVTLTCYDSSDLELRLVGGTNRCMGRVE
          210       220       230       240       250       260       270
      :        ::  ::      ::       ::        ::::           :     :
WC1   HELFRESSAQVWAEEFRCEGEEPELWVCPRVPCPGGTCHHSGSAQVVCSAYSEVRL-MTNGSSQCEGQVE
         190       200       210       220       230       240       250
```

Fig. 58A

```
        280         290         300         310         320         330         340
Hum.   LKIQGRWGTVCHHKWNNAAADVVCKQLGCGTALHFAGLPHLQSGSDVVWLDGVSCSGNESFLWDCRHSGT
       ::  ::  : : ::::: :: : :::::::: ::::: :: ::::: ::: ::: ::::: : ::: ::
WC1    MNISGQWRALCASHWSLANANVICRQLGCGVAISTPGGPHLVEEGDQILTARFHCSGAESFLWSCPVTAL
        260         270         280         290         300         310         320

350         360         370         380         390         400         410
Hum.   VNFDCLHQNDVSVICSDGADLELRLADGSNNCSGRVEVRIHEQWTICDQNWKNEQALVVCKQLGCPFSV
       ::: :::::::: :::::: ::::::::::  ::::::::::  :::  :   :::::::::    ::
WC1    GGPDCSHGNTASVICS-GNQI------------------------------------QVLPQCND-----SV
        330         340                                          350

420         430         440         450         460         470         480
Hum.   FGSRRAKPSNEARDIWINSISCTGNESALWDCTYDGKAKRTCFRRSDAGVICSDKADLDLRLVGAHSPCY
                                                    ::: :  ::       :
WC1    ----SQPTGSA--------------------ASEDSA----PY------------CSDSRQL--RLVDGGGPCA
            360                                                370

490         500         510         520         530         540         550
Hum.   GRLEVKYQGEWGTVCHDRWSTRNAAVVCKQLGCGKPMHVFGMTYFKEASGPIWLDDVSCIGNESNIWDCE
       :: ::   :  :: :::::   :: ::::::::: :: :: :: :: :::::::::::::: :: :::
WC1    GRVEILDQGSWGTICDDGWDLDDARVVCRQLGCGEALNATGSAHFGAGSGPIWLDNLNCTGKESHVWRCP
        390         400         410         420         430         440         450
```

Fig. 58B

```
        560        570        580        590        600        610        620
Hum.  HSGWGKHNCVHREDVIVTCSGDATWGLRLRLVGGSNRCSGRLEVYFQGRWGTVCDDGWNSKAAAVVCSQLDC
      ::::::: :::: :    ::::     .:.      .::.:::.   ::::..  : ::.: :  :  ::
WC1   SRGWGQHNCRHKQDAGVICS--EFLALRMVSEDQQCAGWLEVFYNGTWGSVCRNPMEDITVSTICRQLGC
         460        470        480        490        500        510        520

630        640        650        660        670        680        690
Hum.  PSSIIGMGLGNASTGYGKIWLDDVSCDGDESDLWSCRNSGWGNNDCSHSEDVGVICSDASDMELRLVGGS
      ::. : :.: :.:.:  ::: : :::.:  .  ..::.: .   :.:. :::::::. ::::.::::::
WC1   GDSGTLNSSVALREGFRPQWVDRIQCRKTDTSLWQCPSDPWNYNSCSPKEEAYIWCADSR--QIRLVDGG
         530        540        550        560        570        580        590

700        710        720        730        740        750        760
Hum.  SRCAGKVEVNVQGAVGILCANGWGMNIAEVVCRQLECGSAIRVSREPHFTERTLHILMSNSGCTGGEASL
      .::.:.:::.. :.:: ::. ::.   :.:::.:.::: ..  :.:    : ..: .:::.:  ::..:
WC1   GRCSGRVEILDQGSWGTICDDRWDLDDARVVCKQLGCGEALDATVSSFFGTGSGPIWLDEVNCRGEESQV
         600        610        620        630        640        650        660

770        780        790        800        810        820        830
Hum.  WDCIRWEWKQTACHLNMEASLICSAHRQPRLVGADMPCSGRVEVKHADTWRSVCDSDFSLHAANVLCREL
      : ::.  ::: .:: :.:..::::    .:::. . :::::::.::. ::.:: :::..    ::::.:
WC1   WRCPSWGWRQHNCNHQEDAGVICSGF--VRLAGGDGPCSGRVEVHSGEAWTPVSDGNFTLPTAQVICAEL
         670        680        690        700        710        720        730
```

Fig. 58C

```
Hum.    NCGDAISLSVGDHFGKGNGLTWAEKFQCEGSETHLALCPIVQHPEDTCIHSREVGVVCSRYTDVRLV-NG
            840       850       860       870       880       890       900
             :::   : :::::::  .  :::     . :  : :::::: ::    :: ::::    ::
WC1     GCGKAVSVLGHMPFRESDGQVWAEEFRCDGGEPELWSCPRVPCPGGTCLHSGAAQVVCSVYTEVQLMKNG
         740       750       760       770       780       790       800

Hum.    KSQCDGQVEINVLGHWGSLCDTHWDPEDARVLCRQLSCGTALSTTGGKYIGERSVRVWGHRFHCLGNESL
            910       920       930       940       950       960       970
        ::::   :::: : :::.::: :.:::: :::: ::.  :..  ::  . ::     . ::  :::::
WC1     TSQCEGQVEMKISGRWRALCASHWSLANANVVCRQLGCGVAISTPRGPHLVEGGDQISTAQFHCSGAESF
         810       820       830       840       850       860       870

Hum.    LDNCQMTVLGAPPCIHGNTVSVICTGSLTQPLFPCLANVSDPYLSAVPEGSALICLEDKRLRLVDGDSRC
            980       990       1000      1010      1020      1030      1040
        : ::  ::::.::: ::::.:::: :  : :   :  . :  ::: :  :    :::: ::::::: :
WC1     LWSCPVTALGGGPDCSHGNTASVICSGNHTQVLPQCNDFLSQPAGSAASEESSPYCSDSRQLRLVDGGGPC
         880       890       900       910       920       930       940

Hum.    AGRVEIYHDGFWGTICDDGWDLSDAHVVCQKLGCGVAFNATVSAHFGEGSGPIWLDDLNCTGTESHLWQC
            1050      1060      1070      1080      1090      1100      1110
        .::::: :: :: ::::: :::: ::::: ::::::.::::::: :.:::::::::::::: :::: :
WC1     GGRVEILDQGSWGTICDDDWDLDDARVVCRQLGCGEALNATGSAHFGAGSGPIWLDDLNCTGKESHVWRC
         950       960       970       980       990       1000      1010
```

Fig. 58D

```
     1120      1130      1140      1150      1160      1170      1180
Hum. PSRGWGQHDCRHKEDAGVICSEFTALRLYSETETESCAGRLEVFYNGTWGSVGRRNITTAIAGIVCRQLG
     ::::::::::::::::::::: ::::::   :: ::::::::::::::::::::::  .:::  :::::
WC1  PSRGWGRHDCRHKEDAGVICSEFLALRMVSEDQQ--CAGWLEVFYNGTWGSVCRSPMEDITVSVICRQLG
         1020      1030      1040        1050      1060      1070

1190      1200      1210      1220      1230      1240
Hum. CGENGVVSLAPLSKTGSGFMWVDDIQCPKTHISIWQCLSAPWERRISSPAEETWITCEDR---------
     :::::::: ::  ::  :  ::  ::  ::  ::: ::    :: ::  :::   ::
WC1  CGDSGSLNTSVGLREGSRPRWVDLIQCRKMDTSLWQCPSGPWKYSSCSPKEEAYISCEGRRPKSCPTAAA
         1080      1090      1100      1110      1120      1130      1140

1250      1260      1270      1280      1290      1300
Hum. ------IRVRGGDTECSGRVEIWHAGSWGTVCDDSWDLAEAEVVCQQLGCGSALAALRDASFGQGTGTIW
           :::::::  ::::::: :: :::::::::: ::::::::::::::::  ::::::: :::::::
WC1  CTDREKLRLRGGDSECSGRVEVWHNGSWGTVCDDSWSLAEAEVVCQQLGCGQALEAVRSAAFGPGNGSIW
         1150      1160      1170      1180      1190      1200      1210

1310      1320      1330      1340      1350      1360
Hum. LDDMRCKGNESFLWDCHAKPWGQSDCGHKEDAGVRCSG----------QSLKSLNASSGHLALI
     ::: ::::::  :::: : ::::::    ::::::::          ::  :: :: :  :::
WC1  LDEVQCGGRESSLWDCVAEPWGQSDCKHEEDAGVRCSGVRTTLPTTAGTRTTSNSLPGIFSLPGVLCLI
         1220      1230      1240      1250      1260      1270      1280

Fig. 58E
```

```
         1370        1380         1390        1400         1410
Hum. LSSIFGLLLLVLFILFLTWCRVQK-----QKHLPLRVS------TRRRG------SLEENLFHEME
     : ::::::. :  :::::.  ::::.    : :: :::       :  :        ::: ::. :
WC1  LGSLLFLVLVILVTQLLRW-RAERRALSSYEDALAEAVYEELDYLLTQKEGLGSPDQMTDVPDENYDDAE
         1290        1300         1310        1320         1330        1340        1350

1420                  1430              1440
Hum. TC-------LKREDPHGTRTSD---------DTPNHGCEDAS----------------DTSLLGV
     .:       : : :  .  ::           : ..: ::..                 ::::::
WC1  EVPVPGTPSPSQGNEEEVPPEKEDGVRSSQTGSFLNFSREAANPGEGEESFWLLQGKKGDAGYDDVELSA
         1360        1370        1380         1390        1400         1410        1420

1450
Hum. LPASEAT-K
     :  : .: :
WC1  LGTSPVTFS
     1430
```

Fig. 58F

```
Hum.  ATGATGCTGCCTCAAAACTCGTGGCATATTGATTTTGGAAGATGCTGCTGTCATCAGAACCTTTCTCTG
      : ::                            : :: : :                : :::: :::
WC1   ATG--------GCTC-TGG---------------GCAGACA------CCTCT-CCCTG
               10                       20

Hum.  CTGTGGTAACTTGCATCCTGCTCCCTGAATTCCTGCTTTCTCATCAGCAGTTTTAATGGAACAGATTTGGA
      :: ::: :::::: ::::::: ::::: : :              :   :::: ::
WC1   C-GGGACTCT-GTGTCCTCCCT------CGGCA------C-----CATGGTGGGTGGTCAAGCTCTGGA
          30          40           50              60          70          80

Hum.  GTTGAGGCTGGTCAATGGAGAGACGGTCCCTGCTCTGGGACAGTGGAGGTGAAATTCCAGGGACAGTGGGGG
      : ::::::: :::::::::::::::::::::::::::::::::::::::::::
WC1   GCTGAGGTTGAAGGATGGAGAGTCCCATCGCTGTGAGGGGAGAGTGAAGTGAAGCACCAAGGAGAATGGGGC
         90          100         110         120         130         140         150

Hum.  ACTGTGTGATGATGGGTGGAACACTGCCT-CAACTGTCGTGTCTGTGCAAACAGCTTGGATGTCCATTT
       :::::: ::: :::::::::::::::: :::::::::::::::::::::::::::::::::::::::
WC1   ACAGTGGATGGTTACAGGTGGA-CATTGAAGGATGCATCTGTAGTGTGCAGACAGCTGGGGTGTGGAGCT
         160         170          180         190         200         210
```

Fig. 59A

```
            280       290       300       310       320       330       340
Hum.  TCTTTCGCCATGTTTCGTTTTGGACAAGCCGTGA--CTAGAACATGGAAAAATTTGGCTTGATGATGTTTC
      ::         :: :: :            :: :::        ::::::::: :: ::: ::: :
WC1   GCCATTG--GTTTTCCTGGAGGGGGCTTATTTTGGGCCAGGACTTGGCCCCATTTGGCTTTTGTATACTTC
            220       230       240       250       260       270       280

350       360       370       380       390       400       410
Hum.  CTGTTATGGAAATGAGTCAGCTCTCTGGGAATGTCAACACCGGGAATGGGAAGCCATAACTGTTATCAT
      :::           :::::::::  ::  :::  :::    :::       ::::   ::
WC1   ATGTGAAGGACAGAGTCAACTGTCAGTGTCACTGTCAGTGAGCAT-TCTAATATTAAAGAC-TATC-GTAATGAT
            290       300       310       320       330       340       350

420       430       440       450       460       470       480
Hum.  GGAGAAGATGTTGGTGTGTGAACTGTTATGGTGTGAAGCCAA-TCTGGGTTTGAG--GCTAG-TGGATGGAAAC
      ::      :: :::     :  :                    ::::::::::::
WC1   GGCTATAATCATGTCGGGA---TGCTGGAGTAGTCTGCTCAGGATTTGTGCGTCTGGCTGGAGGGGATG
            360       370       380       390       400       410       420

490       500       510       520       530       540       550
Hum.  AACTCCCTGTTCAGGGAGAGTGGAGGTGAAATTCCAAGAAAAGGTGGGGGACTATATGTGATGATGGGTGGA
      .::      :: ::::::::::                    ::        ::: :::::::
WC1   GAC-CCTGCTCAGGGCGAGTAGAAGTGCATT--CTGGAGAAGCTTGGATCCCAGTGT-CTGATGGGAACT
            430       440       450       460       470       480

Fig. 59B
```

```
Hum.  ACTTGAATACTGCTGCCGTGGTGTGCAGGCAACTAGGATGTCCATCTTCTTTTATTTCTTCTGGAGTTGT
           560       570       580       590       600       610       620
      :::::::: :::::::                     :::                 ::::::: :::
WC1   TCACACTTGCCACTGCC-----------CAG-----------ATCATCTGT-------GCAGAGTTGGG
           490       500                                  510       520

Hum.  TAATAGCCCTGCTGTATTGCGCCCCATTTGGCTGGATGACATTTTATGCCAGGGAATGAGTTGGCACT-
           630       640       650       660       670       680       690
      :::::::                  ::::::: :::::::   :::::::::::::::     :::::
WC1   TTGTGGC------------------AAGGCTG--TGTCTGT-----CCTGGGACACATGAG----CTCTT
           530                       540                  550       560

Hum.  CTGGAATTGCAGACATCGTGGATGGGGAAATCATGACTGCAGTGCACAATGAGGATGTCACATTAACTTGT
           700       710       720       730       740       750       760
      :::::::      ::      ::::::: :::   ::::::::::::::::::     ::::::  ::
WC1   CAGAGAGTCCAGT-GCC----------CAGGTCTG--GGC-----TGAAGAGTTCA------GG
           570       580                   590                  600

Hum.  TATGATAGTAGTGATCTTGAACTAAGGCTTGTAGGTGGAACTAAACCGTGCTGTATGGGGAGAGTAGAGCTGA
           770       780       790       800       810       820       830
      :::::: :: :::::: :::::::::::::::::::: ::            :::::::     :::
WC1   TGTGAGGGGAGGAGCCTGAGCT-----CT-------GGGTCTGCCCC-CAGAGTG--------CCCTG-
           610       620                   630                  640       650
```

Fig. 59C

```
Hum.  AAATCCAAGGAAGGTGGGGGACCGTATGCCACCATAAGTGGAACAATGCTGCAGCTGATGTCGTATGCAA
       :::::  ::::::  :::::  :  :::::  :::::  :::::  :::::  :::::  :::::
WC1   ---TCCA-------GGGGGCACGTGT--CACCACA-GTGGATC--TGCT-CAGGTTGTTTGTTCAGCAT
           660            670           680           690           700

Hum.  GCAGTTGGGATGTGGAACCCGCACTTCACTTCGCTGCCTTGCCTGGCTCATTTGCAGTCAGGGTCTGATGTTGTA
       :::::  :  :::::  :::::  :::::  :  :::::  :  :::::  :::::
WC1   ACT------CAGAAGTCCGGCTCATGACAA-AC-GGCT--CCTC-TCAG-TGTGAAGGGCAGGTGGAGAT
           710           720           730           740           750           760

Hum.  TGGCTTGATGGTGTCTCCCTGCTCCCGGTAATGAATCTTTTCTTTGGGACTGCAGACATTCCCGGAACCGTCA
       :::::  :  :::::  :::::  :::::  :::::  :  :::::  :::::  :  :::::
WC1   GAACATT------TCTG-GACAATGGAGAGCGCTCTGTGCCTCCC-ACTGGAGTCTGGCCAATGCC----A
           770           780           790           800           810           820

Hum.  ATTTTGACTGTCTTCATCAAAACGATGTGTCTGTGATCTGCTCAGATGGAGCAGATTTGAACTGCGACT
       ::  :::::::  :  :::::  :::::  :::::  :::::  :::::  :  :::::
WC1   ATGTTATCTGTCGTCAGCTCGGCTGCTGTGGAGTTGCCATCTCCACCCCCGGAG-------GACCAC-ACT
           830           840           850           860           870           880
```

Fig. 59D

```
                1120       1130       1140       1150       1160       1170       1180
Hum. AGCAGATGGAAGTAACAATTGTTCAGGGAGAGTAGAGGTGAGAATTCA-TGAACAGTGGTGGACAATATG
      : ::          :::::: .   : : ::::::: . ::.: .       :: ::    :     ::
WC1  TG---GTGGAAGAAG---GTGATCAG--ATCCTAACAGCCCGATTTCACTGCTCTG----GGGC----TG
                890        900       910       920       930

1190       1200       1210       1220       1230       1240       1250
Hum. TGACCAGAACTGGAAGAATGAACAAGCCCTTGTGGTTTGTAAGCAGCTAGGATGTCCGTTCAGCGTCTTT
      .:::: .  :::  ::::: . ::::::    ::: : :::: :::: : : . :  :   . : :
WC1  AGTCCT-TCCTGTGGAGTTGT------CCT-GTGACT-----GCC-CTGGGTGGTCCTGACTGTTCCAT
         940        950          960          970        980        990

1260       1270       1280       1290       1300       1310       1320
Hum. GGCAG-TCGTCGTGCTAAACCTAGTAATGAAAGCTAGAGACATTTGGATAAACAGCATATCTTGCACTGGG
      :::: :  ::  ::  ::: :. ::::::. . :::. :  ::: :  : ::   ::.:    :::
WC1  GGCAACACAGCCTCTGTGATCTGCTCAGGAAAACCAGATCCAGGTGCTTCCCCAGTGCAACGA-CTCCG--
         1000       1010       1020       1030       1040       1050       1060

1330       1340       1350       1360       1370       1380       1390
Hum. AATGAGTCAGCTCTCTGGGACTGCACATATGATGGAAAAGCAAAGCGAACATGCTTCCGAAGATCAGATG
      ::::   . ::       :.          .:           ::  :. ::   ::     :: :::
WC1  --TGTCTCAACCTACAGGCTCTGC-------GGC----CTCAGAGGACA-GCGCCC------CCTACTG
           1070       1080                 1090        1100
```

Fig. 59E

```
Hum. CTGGAGTAATTTGTTCTGATAAGGCAGATCTGGACCTAAGGCTTGTCGGGGCTCATAGCCCCTGTTATGG
     1400      1410      1420      1430      1440      1450      1460
     ::  . :::   :::    :::: ::  :   ::::::: :  : : ::::::  ::
WC1 CTCAGA-------CAG--CAGGCAGCTCCG--CCTGGTG---GACGGGGG-GC--GGTCCCTGCGCCGG
    1110          1120        1130         1140        1150       1160

Hum. GAGATTGGAGGTGAAATACCAAGGAGAGTGGGGGACTGTGTGTCATGACAGATGGAGCACAAGG-AATGC
     1470      1480      1490      1500      1510      1520
     ::::::::::     :    ::::::::::::  ::::  ::: ::::::  :::::::::: :::::
WC1 GAGAGTGGAGATCCTTGACCAGGGGCTCCTGGGGCACCATCTGTGATGACGGCTGGGAC-CTGGACGATGC
    1170      1180      1190      1200      1210      1220

Hum. A-GCTGTGTGTAAACAATTGGGATGTGGA-AAGCCTATGCATGTGTTTGTATGACCTATTTTAAAG
     1530      1540      1550      1560      1570      1580      1590
     :: ::::  ::::::.:  :: :::::  :::::::::::::::::::::::::::: :::::  :::
WC1 CCGC-GTGGTGTGCAGGCAGCTGGGCTGTGTGGAGAAGCCCTCA-ATGCCACGGGGTCTGCTCACTTCGGGG
    1230      1240      1250      1260      1270      1280      1290

Hum. AAGCATCAGGACCTATTTGGCTGGATGACGTTTCTTGCATTGGAAATGAGTCAAATATCTGGGACTGTGA
     1600      1610      1620      1630      1640      1650      1660
     ::  :::::::::::: :::   : ::::  ::::::::::   ::::   :   :::::::::::::
WC1 CAGGATCAGGCCCCATCTGGTTGGACAACTTGAACTGCACAGGAAAGGAGTCCCACGTGTGGAGGTGCCC
    1300      1310      1320      1330      1340      1350      1360
```

Fig. 59F

```
           1670       1680       1690       1700       1710       1720       1730
Hum. ACACAGTGGATGGGGAAAGCATAAATTGTGTACACAGAGAGGATGTGATTGTAACCTGCTCAGGTGATGCA
     :  ::  ::::::  ::  :::::::  ::     :   : ::::::::   ::
WC1  TTCCCGGGGCTGGGGGCAGCACAACTGCAGACACAAGCAGGACGCGGGGGTCATCTGCTCAG--AGTTC-
           1370       1380       1390       1400       1410       1420       1430

1740       1750       1760       1770       1780       1790       1800
Hum. ACATGGGGCCTGAGGCTGTGGTGGGCGCAGCAACCGCTGCTCGGGAAGACTGGAGGTGTACTTTCAAGGAC
     :  :::  ::: :       :::::::    ::   :  ::   :::: :::
WC1  -CT--GGCCCCTCAGGAGGATGGTGAGTGTGAGGACCAGTGTGCTGGGCTGGGAAGTTTTCTACAATGGGA
           1440       1450       1460       1470       1480       1490       1500

1810       1820       1830       1840       1850       1860       1870
Hum. GGTGGGGCACAGTGTGTGATGACGGCTGGAACAGTAAAGCTGCAGCTGTGGTGTGTAGCCAGCTGGACTG
     ::::::::   ::          :  ::::    :::::::::  :: : :::::
WC1  CCTGGGGCAGTGTGTCTGCGCCGTAACCCCATGGAAGACATCACTGTGTCCACGATCTGCAGACAGCTTGGCTG
           1510       1520       1530       1540       1550       1560       1570

1880       1890       1900       1910       1920       1930       1940
Hum. CCCATCTTCTATCATTGGCATGGGGTCTG-GGAAACGCTTCTA-CAGGATATATGGAAAAATTTGGCTCGATG
     :::::        ::          ::: :  :      :::     :::::::::
WC1  T--GGGGACAGTGGAACCCCTCAACTCTTCTGTTGCTCTTAGAGAGAAGGTTTTAGGCCACAGTGGGTGGAT-
           1580       1590       1600       1610       1620       1630
```

Fig. 59G

```
              1950      1960      1970      1980      1990      2000      2010
Hum.  ATGTTTCCTGTGACTGATGGAGATGAGTCAGATCTCTGGTCATGCAGGAACAGTGGGTG--GGGAAATAATGAC
      ::  :: :::  ::::::  ::::: ::: ::: ::    ::     :::  :       :::         ::
WC1   -AGAATCCAGTGTCGGAAAACTGACACCCTCT---CTGGCAGTGTCCTTCTGACCCTTGGAATTACAAAC
          1640      1650      1660      1670      1680      1690      1700

2020      2030      2040      2050      2060      2070      2080
Hum.  TGCAGTCACAGTGAAGATGTTGGAGTG-ATCTGTTCTGATG-CATCGGATATGGAGCTGAGGCTTGTGGG
      ::  :  :::::   ::   :::  :: :  : :::::::  :::::::::::: :::::  :::    :::
WC1   T-CATGCTCTCCAAAGGAGGAAGCCTATATCTGGTGTGCAGACAGCAGACA--GATCCGC---CTGGTGGA
          1710      1720      1730      1740      1750      1760

2090      2100      2110      2120      2130      2140      2150
Hum.  TGGAAGCAGCAGGTGTGCTGGAAAAGTTGAGGTGAATGTCCAGGGTGCCGTGGAATTCTGTGTGCTAAT
      :: :::::::::::::::::: ::: : ::::::::: ::::::: : ::::  :: :::::::::::::
WC1   TGGAGGTGGTCGCTGCTCTGGGAGAGTGAGAGTGGAGATCCTTGACCAGGGCTCCTGGGCACCATCTGATGAC
          1770      1780      1790      1800      1810      1820      1830

2160      2170      2180      2190      2200      2210      2220
Hum.  GGCTGGGAATGAACATTGCTGAAGTTGTTTGCAGGCAACTTGAATGTGGGTCTGCAATCAGGGTCTCCA
       :::::::  :::: ::::: :: :: ::::::::::: ::: :: ::::::::::::::   :::::::
WC1   CGCTGGGACCTGGACGATGCCCGTGGTGTGCAAGCAGCTGGGCTGTGGAGAAGC---CCTGGACGCCCA
          1840      1850      1860      1870      1880      1890      1900
```

Fig. 59H

```
           2230      2240      2250      2260      2270      2280
Hum.  GAGA-GCCTCATTTCACAGAA--AGAACATTACACATCTTAATGTCGAATTCTGGCTGCACTGGAGGGGA
      ::  : :: ::  :     ::::::  : :::::::  :  ::::::: :::::: ::
WC1   CTGTCTCTTCTTCCTTCTTCGGGACGGGATCAGGGCCCATCTGGCTGGATGAAGTGAACTGCAGAGGAGAGGA
           1910      1920      1930      1940      1950      1960      1970

2290      2300      2310      2320      2330      2340      2350
Hum.  AGCCCTCTCTGGGATTGTATACGATGGGAGTGGAAACAG-ACTGCGTGTCATTTAAATATGGAAGCAAG
         ::    :      : ::      :::::    : :  :::::: :  ::    : :
WC1   GTCCCAAGTATGGAGGTGCCCTTCCTGGGGATGGCGGCAACACAAC-TGCAATCATCAAGAAGATGCAGG
           1980      1990      2000      2010      2020      2030      2040

2360      2370      2380      2390      2400      2410      2420
Hum.  TTTGATCTGCTCAGCCCCACAGGCAGCCCAGGCTGGTTGGAGCTGATATGCCCTGCTCTCTGGACGTGTTGAA
        ::       ::  ::                      :: :       ::  :::    :::: ::
WC1   AGTCATCATCTGCTGCTCAGGATTTGTGC-----GTCTGGCTGGAGGAGATGGACCCTGCTCAGGGGCGAGTAGAA
           2050      2060      2070      2080      2090      2100

2430      2440      2450      2460      2470      2480      2490
Hum.  GTGAAACATGCAGACACATGGCGCTTCTGTCTCTGTGATTCTGATTTCTCTCTTCATGCTGCCAATGT--GCT
      ::: :    ::  ::     ::     :::         ::::        ::   :           ::
WC1   GTGCATTCTGGAGAAGCCTGACCCCAGTGTCTGATGGAAACTTCACACTCCCCACTGCCCCAGGTCATCT
           2110      2120      2130      2140      2150      2160      2170
```

Fig. 59I

```
              2500      2510      2520      2530      2540      2550      2560
Hum.  GTGCAGAGAATTAAATTGTGGAGATGCCATATCTCTTTCTGTGGGAGATCACTTTGGAAAAGGG-AATGG
      ::::::::  ::::::::::  ::  ::::::::  :::::::  :  ::::::  ::::::: :::::
WC1   GTGCAGAGC--TGGGATGTGGCAAGGCTGTGTCT-GTCCTGGGACACATGCCATTCAGAGAGTCCGATGG
           2190      2200      2210      2220      2230      2240

2570      2580      2590      2600      2610      2620      2630
Hum.  TCTAACTTGGGCCGAAAAGTTCCAGTGTGAAGGGAGTGAAACTCACCTTGCATTATGCCCCATTGTTCAA
      ::  :  :::::::  :::::  ::::::  ::::  :::::  :: :::::: :  :::::  ::::
WC1   CCAGGTCTGGGCTGAAGAGTTCAGGTGTGATGGGGAGCCTGAGCTCCTGGTCCTGCCCCAGAGTGCCC
           2250      2260      2270      2280      2290      2300      2310

2640      2650      2660      2670      2680      2690      2700
Hum.  CATCCGGAAGACACTTGTATCCACAGCAGAGAAGTTGGAGTTGTCTGTTCCCGATATACAGATGTCCGAC
      :::::::::  :::: ::: ::::::  ::::::::::  :: ::::::  ::   ::::: ::::::
WC1   TGTCCAGGAGGCACATGTCTCCACAGTGCTGCTCCAGGTTGTCTGTTCAGTGTACACAGAAGTCCAGC
           2320      2330      2340      2350      2360      2370      2380

2710      2720      2730      2740      2750      2760      2770
Hum.  TTGTGAATGGCAAATCC---CAGTGTGACGGGCAAGTGGAGATCAACGTGCT-TGGACACTGGGGCTCAC
      ::  ::::   ::::    ::::::::  :::::::::::    ::::::  ::::::   :::::::
WC1   TTATGAAAAACGGCCACCTCTCAATGTGAGGGGCAGGTGGAGAT-GAAGATCTCTGGACGATGGAGAGCGC
           2390      2400      2410      2420      2430      2440      2450
```

Fig. 59J

```
              2780      2790      2800      2810      2820      2830      2840
Hum.   TGTGTGACACCCACTGGGACCCCAGAAGATGCCCGTGTTCTATGCAGAGAACAGCTCAGCTGTGGGACTGCTCT
       : : :::  : :::::::::  :  :::::::: : :::  : :::: :::: :: :::: :: :::::::
WC1    TCTGTGCCTCCCACTGGAGTCTGGCCAATGTTGTCTGTCGTCAGCTCGGCTGTGGAGTCGCCAT
          2460      2470      2480      2490      2500      2510      2520

2850      2860      2870      2880      2890      2900      2910
Hum.   CTCAACCACAGGAGGAGAAAATATATTGGAGAAAGAAGTGTTCGTGTGTGGGGACACAGGTTTCATTGCTTA
       ::  ::::  :::: :::    ::: :: :: ::: ::::: ::::: ::  :::  :::  ::: :::
WC1    CTCCACCCCCAGAGAGACCACACTGGTGGTGAGGAGTGATCAGATCTCAACAGCCCAATTTCACTGCTCA
          2530      2540      2550      2560      2570      2580      2590

2920      2930      2940      2950      2960      2970      2980
Hum.   GGGAATGAGTCACTTCTGGATAACTGTCAAAATGACAGTTCTTGGAGCACCTCCCTGTATCCATGGAAATA
       :::  :::: : :: :::::: :: ::: :: :: :: ::::  ::::  ::::::  :::::::::::
WC1    GGGGCTGAGTCCTGTCCTGTGAGTTGTCCTGCCTTGGGTTGGGCCTGACTGTTCCCATGGCAACA
          2600      2610      2620      2630      2640      2650      2660

2990      3000      3010      3020      3030      3040      3050
Hum.   CTGTCTCTGTGATCTGCACAGGAAGCCTGACCCACTGTTTCCATGCCTCGCAAATGTATCTGACCC
       ::::::::::::::: :::: ::::: :::::::::: :::: ::::: ::: :::  :::::
WC1    CAGCCCTCGTGATCTGCTCAGGAAACCACCCAGGTGCTGCCCCAGTGCAACGACTTCCTGTCTCAACC
          2670      2680      2690      2700      2710      2720      2730
```

Fig. 59K

```
Hum.  ATATTTGTCTGCAGTTCCAGAGGGCAGTGCTTTGATCTGCTTAGAGGACAAACGGCTCCGCCTAGTGGAT
           3060      3070      3080      3090      3100      3110      3120
           : ::::    ::   :: :  :::::    :: ::  ::  ::::::::::::::  ::
WC1.  TGCAGGCTCTGCGGCCTCGCGGAGAGTTCTCCCTACTGCTCAGACAGCAGGCAGCTCCGCCTGGTGGAC
           2740      2750      2760      2770      2780      2790      2800

Hum.  GGGGACAGCCGCTGTGCCGGGAGAGTAGAGATCTATCACGACGGCTTCTGGGCACCATCTGTGATGACG
           3130      3140      3150      3160      3170      3180      3190
           :::::  :  :  :::::: ::::::::::::::::::::::::::::::::::::::::::::
WC1.  GGGGCGGTCCCTGCGCGGGAGAGTGGAGATCCCTTGACCAGGCTCCTGGGCACCATCTGTGATGATG
           2810      2820      2830      2840      2850      2860      2870

Hum.  GCTGGGACCTGAGCGATGCCCACGTGGTGTGTCAAAAGCTGGGCTGTGGAGTGGCCTTCAATGCCACGGT
           3200      3210      3220      3230      3240      3250      3260
           ::::::::::: :  :::::::::::::::::  :::::::::::::::::::::::::::::
WC1.  GCTGGGACCTGGGACGATGCCCGTGTGGTGTGTCAGGCAGCAGCTGTGGAGAAGCCCTCAATGCCACGGG
           2880      2890      2900      2910      2920      2930      2940

Hum.  ACTGGGACCTGGACGATGCAGGGCCCATCTGGCTGATGACCTGAACTGCACAGGAACGGAGTCC
           3270      3280      3290      3300      3310      3320      3330
           ::::::::: :: :::::::  :::::: ::::::::::::::::::::::::::::::::::::
WC1.  GTCTGCTCACTTCGGGCAGGATCAGGGCCCATCTGGCTGACGACCTGAACTGCACAGGAAAGGAGTCC
           2950      2960      2970      2980      2990      3000      3010
```

Fig. 59L

```
              3340         3350         3360         3370         3380         3390         3400
Hum.  CACTTGTGGCAGTGCCCCTTCCCGCGGCTGGGGCAGCAGCGACTGCAGGCACAAGGAGGACGCAGGGTCA
      ::: ::::::   :: :::::::::::::::::::::: :::::::::::::::::::::::::::::::
WC1   CACGTGTGGAGGTGCCCCTTCCCGGGGCTGGGGCGGCAGCGACTGCAGACACAAGGAGGACGCCGGGTCA
      3020         3030         3040         3050         3060         3070         3080

3410         3420         3430         3440         3450         3460         3470
Hum.  TCTGCTCAGAATTCACAGCCTTGAGGCTCTACAGTGAAACTGAAACAGAGAGCTGTGCTGGGAGATTGGA
      :::::::::::  :::   :::::::::  :: : : :::::   ::::::::::::::::::  ::::
WC1   TCTGCTCAGAGTTCCTGGCCCCTCAGGAT---GGTGAG-CGAGGACCAGCAG-TGTGCTGGGTGGCTGGA
      3090         3100         3110         3120         3130         3140

3480         3490         3500         3510         3520         3530         3540
Hum.  AGTCTTCTATAACGGGACCTGGGCCAGCGTCGGCAGGAGGAACATCACCACAGCCATAGCAGGCATTGTG
      ::   : ::: :::::: :::::  ::: ::::::::::::::::::::::::::: :::::::::: :
WC1   GGTTTTCTACAACGGGACCTGGGCAGCAGTCTGCAGGAGGAACATCACCACAGCCATTGCAGGCATTATC
      3150         3160         3170         3180         3190         3200         3210

3550         3560         3570         3580         3590         3600
Hum.  TGCAGGCAGCTGGGGCTGTGGGGAGAATGGAGTTGTCAGCCTCGCCCCTTTA--TCT-AAGACAGGCTCTG
      ::::::::::: :::::::::: ::::  :::::   :: :::::  ::::   ::: ::::::: ::::
WC1   TGCAGGCAGCTTGGGCTGTGGGGACAGTGGA--AGTCT-CAACACCTCTGTTGGTCTCAGGGAAGGTTCTA
      3220         3230         3240         3250         3260         3270         3280
```

Fig. 59M

```
       3610      3620      3630      3640      3650      3660      3670
Hum.  GTTTCATGTGGGTGGATGACATTCAGTGTCCTAAAAACGCATATCTCCATATGGCAGTGCCTGTCTGCCCC
      : :  : :::::: ::: ::: :::  :::   :::  ::: ::::::   : ::::::::::::: :::
WC1   GACCCCGGTGGGTAGATTTAATTCAGTGTCGGAAAATGGATACCTCTCTGCAGTGTCCTTCTGGCCC
       3290      3300      3310      3320      3330      3340      3350

3680      3690      3700      3710      3720      3730      3740
Hum.  ATGGGAGCGAAGAATCTCCAGCCCAGCAGAAGAGACCTGGATCACATGTGAAGATAGAATA----AGAG-
      ::::::::: ::: :::   : :    : :::::  :::::: :::::::::::::::: :      : :::
WC1   ATGGAAATACAGTTCATGCTCTCCAAAGGAGGAAGCCTACACATCTCATGTGAAGGAAGAACCCAAGAGC
       3360      3370      3380      3390      3400      3410      3420

3750      3760
Hum.  ------------TGC---------------------------GTGGAGGAGACACCGAGTGCTCTG
                  :::                           :: :::::::::: ::::::::::: :::
WC1   TGTCCAACTGCTGCCGCCCTGCACAGACAGAGAGAAGCTCCGCCTCAGGGGAGGAGACAGCAGTGCTCAG
       3430      3440      3450      3460      3470      3480      3490

3770      3780      3790      3800      3810      3820      3830
Hum.  GGAGAGTGGAGAGATCTGGCACGCAGGCTCCTGGGGCTCCTGGACTTCCTGGACCTGGCCGAGGC
      ::: ::::::::::  :::: :::::::::::::: :::::::::::::  ::::::::: :::::::
WC1   GGCGGGTGGAGGTGTGGCACAACGGCTCCTGGGGCACCGTGCCGATGACTCCTGGAGCCTGGCAGAGGC
       3500      3510      3520      3530      3540      3550      3560
```

Fig. 59N

```
3840                 3850       3860       3870       3880       3890       3900
Hum.  GGAAGTGTGGTGTGTCAGCAGCTGGGCTGTGGCTCTGCTGGCCTCTGCTGCCCTGAGGGACGCTTCGTTTGGCCAG
      ::::: :::::::::::::::::::::::::: :: :::: :: :: ::: ::       ::      : ::
WC1   TGAGGTGGTGTGTCAGCAGCTGGGCTGTGGCTCTGTGGCCAGCCCTGAAGCCGTGCGGTCTGCAGCATTTGGCCCT
      3570       3580       3590       3600       3610       3620       3630

3910       3920       3930       3940       3950       3960       3970
Hum.  GGAACTGGAACCATCTGGTTGGATGACAGAGTGACTGTGCAAAGGAAATGAGTCATTTCTATGGGACTGTCACG
      :::: :      :::::: ::  :: ::::  ::       :::::      ::  :  : :: :: :: :
WC1   GGAAATGGGAGCATCTGGCTGACGCAGAGGTGCAGTGCGAGGTGCAGTGCCTGGGAGTCCTCCCCGTGGGACTGTGTTG
      3640       3650       3660       3670       3680       3690       3700

3980       3990       4000       4010       4020       4030       4040
Hum.  CCAAACCCTGGGGACAGAGTGACTGTGGACACAAGGAAGATGCTGGCGTGAGGTGCTCTGG----ACAGTC
      :::: ::::::::  :: ::: ::: ::::: ::::: ::::::::: ::::: :::::::    ::
WC1   CGGAGCCCTGGGGGCAGAGCGACTGCAAGCACGCAGGAGGATGCTGGTGTGAGGTGCTCTGGTGTAAGGAC
      3710       3720       3730       3740       3750       3760       3770

4050       4060       4070       4080       4090
Hum.  G-----CTGAAATCACTGAATG--CCT------CCTCAGGT-CATT---TAGCA-CTTATTTTATCCA
      :      :: :       ::    :::      :::: ::: :::       : ::: : ::::::
WC1   AACATTGCCCCACGACCACCAGCAGGACCAGAACAACCTCAAATTCTCTCCCTGGCATCTTCTCCCTGCCT
      3780       3790       3800       3810       3820       3830       3840
```

Fig. 59O

```
                   4100         4110         4120         4130         4140
Hum.  G------TATCTT----TGGGCTC-CTTCTC---CTGGTTCT-------GTTTATTCTATTTCTCA
      :       :: :     :::::: :::::: :  :::::::          ::::::::::::::
WC1   GGGGTTCTCTGCCTTATCCTGGGTCGCTTCTTCCTGGTCCTCGTCATCCTGGTGACTCAGTACTCA
      3850         3860         3870         3880         3890         3900         3910

4150         4160         4170                                4180
Hum.  CGTGGGTG--CCGAGTTCAGAGAACAAAACATCT----:----GCCC----CT---CAGAGTTT-------
      ::::::    ::::::::::::::::::::::::         :::     ::   ::::::::
WC1   CGTGGGTG--CCGAGTTCAGAGAACAAAACATCT----:----GCCC----CT---CAGAGTTT-------
      3920         3930         3940         3950         3960         3970         3980

4190         4200         4210         4220
Hum.  ------CAAC----CAGAAGGAGGG---GTTCT-CTCG----AGGAGAATTTATTCCATGA-------
            ::::    :::::::::::   :::::  :::    :::::::::::::::::::
WC1   GATGGAGAGCAGAGCGCAGAGCCCAGAGAAGGAAGTCTGGGCAGCCCAGATCAGATGACTGATGAAAAT
      3990         4000         4010         4020         4030         4040         4050

4230              4240          4250
Hum.  ---GATGGAG-------ACCTG-----:----CCTC-------------:--AAGAGAGAGGAC------:
         :::::::       :::::     ::   ::::                ::::::::::::::
WC1   TATGATGATGATGCTGAAGAAGTACCAGTGCCTGAACTCCCTTCTCCCTCAGGGAATGAGGAGAAGTGC
      4060         4070         4080         4090         4100         4110         4120
```

Fig. 59P

```
Hum.  CCACATGGGACAAGAAC----------------CTCAGA-TGACAC---CC------CCAA------
      :: :: .::: ::::..::                :::::: .:::::   ::         ::.:
WC1   CCCCAGAGAAGGAGGACGGGGTGAGGTCCTCTCAGAGACAGGCTCTTTCCTGAACTTCTCCAGAGAGGCAGC
      4130           4140           4150           4160           4170           4180           4190
      4260           4270           4280                                                              4290

Hum.  ----CCATGGTT--GTGAAGA----TGCTAGCGACAC-------------ATCGCTG--TTGGGAGTT
          :::::: :   ::::::        : ::::::                ::::::   ::::: :
WC1   TAATCCTGGGAAGGAGAAGAGAGCTTCTGGCTGCTGCTCCAGGGGAAGAAAAGGGGATGCTGGGTATGATGAT
      4200           4210           4220           4230           4240           4250           4260
      4300           4310                         4320           4330

Hum.  CTT-------CCTG-------CCTCTGAAGCCACAAAAA
      :::       :::::       ::::: .::::.::::.
WC1   GTTGAACTCAGTGCCCCTGGGAACATCCCCAGTGACTTTCTCG
      4270           4280           4290           4300
      4340           4350

Fig. 59Q
```

```
                10         20         30         40         50         60         70
Hum.   MALPALGLDPWSLLLGLFLFQLLQLLLPTTTAGGGGQGPMPRVRYYAGDERRALSFFHQKGLQDFDTLLLS
       :::::::::: :::::::::   :::::      ::::::::::::: :: ::::::::::  :::::::::
Mur.   MALPSLGQDSWSLLRVFFFQLFLLPSLPPASGTGGQGPMPRVKYHAGDGHRALSFFQQKGLRDFDTLLLS
                10         20         30         40         50         60         70

80         90        100        110        120        130        140
Hum.   GDGNTLYVGAREAILALDIQDPGVPRLKNMIPWPASDRKKSECAFKKKSNETQCFNFIRVLVSYNVTHLY
       ::::::::::::: :::::::: :::::::::::::::  ::: ::::::::::::::::::::: :::
Mur.   DDGNTLYVGARETVLALNIQNPGIPRLKNMIPWPASERKKTECAFKKKSNETQCFNFIRVLVSYNATHLY
                80         90        100        110        120        130        140

150        160        170        180        190        200        210
Hum.   TCGTFAFSPACTFIELQDSYLLPISEDKVMEGKGQSPFDPAHKHTAVLVDGMLYSGTMNNFLGSEPILMR
       :::::::::::::::::: ::::::: :::      :::             ::::::::::::::::::
Mur.   ACGTFAFSPACTFIELQDSLLLPILIDKVMDGKGQSPLTLFTSTQAVLVDGMLYSGTMNNFLGSEPILMR
               150        160        170        180        190        200        210

220        230        240        250        260        270        280
Hum.   TLGSQPVLKTDNFLRWLHHDASFVAAIPSTQVVYFFFEETASEFDFFERLHTSRVARVCKNDVGGEKLLQ
       ::::  :::::: ::::: :::::::::::::::: ::::::::::::   :::: :::::::::::::
Mur.   TLGSHPVLKTDIFLRWLHADASFVAAIPSTQVVYFFFFEETASEFDFFEELYISRVAQVCKNDVGGEKLLQ
               220        230        240        250        260        270        280
```

Fig. 60A

```
              290        300        310        320        330        340        350
Hum.  KKWTTFLKAQLLCTQPGQLPFNVIRHAVLLPADSPTAPHIYAVFTSQWQVGGTRSSAVCAFSLLDIERVF
      ::::::::::::::::: ::::::::::::::::::: ::::::::::::::::::::::::: ::::::
Mur.  KKWTTFLKAQLLCAQPGQLPFNIIRHAVLLPADSPSVSRIYAVFTSQWQVGGTRSSAVCAFSLTDIERVF
              290        300        310        320        330        340        350

360        370        380        390        400        410        420
Hum.  KGKYKELNKETSRWTTYRGPETNPRPGSCSVGPSSDKALTFMKDHFLMDEQVVGTPLLVKSGVEYTRLAV
      ::::::::::::::::::::: ::::::: ::::::::::::::::::::: :::::::::::::::::
Mur.  KGKYKELNKETSRWTTYRGSEVSPRPGSCSMGPSSDKALTFMKDHFLMDEHVVGTPLLVKSGVEYTRLAV
              360        370        380        390        400        410        420

430        440        450        460        470        480        490
Hum.  ETAQGLDGHSHLVMYLGTTGSLHKAVVSGDSSAHLVEEIQLFPDEPVRNLQLAPTQGAVFVGFSGGVW
      :::: ::::::: ::::::: ::::::: ::::: ::::::: :::::::::: :::::::::::::
Mur.  ESARGLDGSSHVVMYLGTSTGPLHKAVVPQDSSAYLVEEIQLSPDSEPVRNLQLAPAQGAVFAGFSGGIW
              430        440        450        460        470        480        490

500        510        520        530        540        550        560
Hum.  RVPRANCSVYESCVDCVLARDPHCAWDPESRTCCLLSAPNLNSWKQDMERGNPEWACASGPMSRSLRPQS
      ::::::::::::::::::::::::::::::::: ::::::: ::::::::::::::::::::
Mur.  RVPRANCSVYESCVDCVLARDPHCAWDPESRLCSLLSGST-KPWKQDMERGNPEWVCTRGPMARSPRRQS
              500        510        520        530        540        550
```

Fig. 60B

```
Hum.  RPQIIKEVLAVPNSILELPCPHLSALASYYWSHGPAAVPEASSTVYNGSLLLIVQDGVGGLYQCWATENG
           :: :::::::: :::::::::: :::::::: ::::::  :::::::::::  :: :::::::::::  ::::
Mur.  PPQLIKEVLTVPNSILELRCPHLSALASYHWSHGRAKISEASATVYNGSLLLLPQDGVGGLYQCVATENG
         560       570       580       590       600       610       620

Hum.  FSYPVISYWVDSQDQTLALDPELAGIPREHVKVPLTRVSGGAALAAQQSYWPHFVTVTLFALVLSGALI
          :::: ::::::::: :: ::::::: :::: :::::::::  :::  ::::::::::: :: ::: ::
Mur.  YSYPVVSYWVDSQDQPLALDPELAGVPRERVQVPLTRVGGGASMAAQRSYWPHFLIVTVLLAIVLLGVLT
         630       640       650       660       670       680       690

Hum.  ILVASPLRALRARGKVQGCETLRPGEKAPLSREQHLQSPKECRTSASDVDADNNCLGTEVA
          ::::::: :::::::::: :: ::: :::: :::: ::: : ::::::::::: :: :::
Mur.  LLLASPLGALRARGKVQGCGMLPPREKAPLSRDQHLQPSKDHRTSASDVDADNNHLGAEVA
         700       710       720       730       740       750       760
```

Fig. 60C

```
Hum.  GTCG-AC-CC----------ACG-------CGTCCGGT-----CTGTGGCTGAGCATGGC
      :::    ::  ::            ::              :: :::          :: :::::: ::::::  :
Mur.  CTCGGACGCCTGGGTTAGGGGTCTGTACTGCTGGGAACCATCTGGTGACCATCTCAGGCTGACCATGGC
               10         20        30         40        50        60        70

Hum.  CCTCCCCAGCCCCTGGGCCTGGAGACCCCCTGGGCCTTTTCCTCTTCCAACTGCTTC-AGCTGCT
       ::::::::::: :::::::::::::::::  :::::::::::: : :::::: ::::::::: ::::::
Mur.  CCTACCATCCCTGGGCCAGGACTCATGGAGTCTCCTGCGTGTTTTTTCTTCCAACT-CTTCCTGCTGCC
               80        90       100       110       120       130

Hum.  GCTGCCGACGATCGCGCGGGGAGGCGGGCAGGGCCCATGCCCCAGGGTCAGATACTATGCAGGGGAT
       ::::::::: :::::  :  ::  ::::::::::::::::::::::::::::::::::::::: ::::::
Mur.  GCTGCCGACGATCGCGCGGGGAGGCGGGCAGGGCCCATGCCCCAGGGTCAGATACTATGCAGGGGAT
              140       150       160       170

Mur.  ATCACTGCCACCTGCTTCTGGGACTGGTGTCAGGGGCCCAGAGTCAAATACCATGCTGGAGAC
       :::::::::::::::::::::::::::::::::::::::::::::::: ::::::::::::::::::::
Hum.  ATCACTGCCACCTGCTTCTGGGACTGGTGTCAGGGGCCCAGAGTCAAATACCATGCTGGAGAC
              150        160      170       180       190       200

Hum.  GAACGTAGGGCACTTAGCTTCTTCCACCAGAAGGGCCTCCAGGATTTTGACACTCTGCTCCTGAGTGGTG
       :: :::::::::::::  ::::::::::::::::::::::::::::::::::::::::::::::::::::   :
Mur.  GGGCACAGGGCCCTCAGGGCCCTCAGCTTCTTCCAACAAAAAGGCCCTCCAACACTTTGACACGCTGCTCCTGAGTGACG
             220       230       240       250        260       270
```

Fig. 61A

```
              250        260        270        280        290        300        310
Hum.  ATGGAAATACTCTCTACGTGGGGCTCGAGAAGCCATTCTGGCCTTGGATATCCAGGATCCAGGGGTCCC
      ::::: :: ::::::::: ::::::::::::::::::::::::: :::::::::::::: :::::::::
Mur.  ATGGCAACACTCTCTATGTGGGGCTCGAGAGACCGTCCTGGCCTTGAATATCCAGAACCCAGGAATCCC
              280        290        300        310        320        330        340

320        330        340        350        360        370        380
Hum.  CAGGCTAAAGAACATGATACCGTGGCCAGCCAGTGACAGAAAAAGAGTGAATGTGCCTTTAAGAAGAAG
      ::::::::::::::::::::::::::::::::::::::::: :::::::::::::::::::::::::::
Mur.  AAGGCTAAAGAACATGATACCCTGGCCAGCCAGTGAGAGAAAAAGACCGAATGTGCCTTTAAGAAGAAG
              350        360        370        380        390        400        410

390        400        410        420        430        440        450
Hum.  AGCAATGAGACACAGTGTTTCAACTTCATCCGTGTCCTGGTTTCTTACAATGTCACCATCTCTACACCT
      ::::::::::::::::::::::::::::::::::::::::::::::: ::::: ::::::: :: :::
Mur.  AGCAATGAGACACAGTGTTTCAACTTCATTCGAGTCCTCTTACAATGTCTACTACCACCTCTATGCCT
              420        430        440        450        460        470        480

460        470        480        490        500        510        520
Hum.  GCGGCACCTTCGCCTTGCCTTCAGCCCTGCTTGTACCTTGAACTTCAAGATTCCTACCTGTTGCCATCTC
      : :: :::::: :::::: ::::::::::: ::::::::::::::::: ::: ::::::::::::: ::
Mur.  GTGGGACCTTTGCCTTGCCCTCAGCCCCTGCCTGTACCTTGAACTTCATTGAACTCCAAGATTCCCCTGTTGCCCATCTT
              500        510        520        530        540        550

Fig. 61B
```

```
Hum.  GGAGGACAAGGTCATGGAGGAAAAGGCCAAAGCCCCCTTTGACCCCGCTCACAAGCATACG-GCTGTCTT
      :::::::::::::::::::::  :::::  :::::::::  :  :::::::::::  ::::::: :::::::
Mur.  GATAGACAAGGTCATGGACGGGAAGGGCCAAAGCCC-TTTGACCCTGTTCACAAGCACACAAGCTGTCTT
           530       540       550       560       570       580       590
           560       570       580       590       600       610       620

Hum.  GGTCGATGGGATGCTCTATTCTGGTACTATGAACAACTTCCTGGGCAGTGAGCCCATCCTGATGCGCACA
      :::::::::::::::: ::::: :::::  :::::::::::::::::::::::::::::::::::  ::
Mur.  GGTCGATGGGATGCTTTATTCCGGCACCATGAACAACTTCCTGGGCAGCGAGCCCATCCTGATGCGGACA
           600       610       620       630       640       650       660
           630       640       650       660       670       680       690

Hum.  CTGGGATCCCCAGCCCTGTCCTCAAGACCGACAACTTCCTCCGCTGGCTGCATCATGACGCCTCCTTGTGG
      ::::::::::::::::::::::::::  ::::::  :::::::::::::::  ::  :: ::::::::::
Mur.  CTGGGATCCCCATCCCTGTTCTCAAGACTGACATCTTCTTACGCTGGCTGCACGCGGATGCCTCCTTCGTGG
           670       680       690       700       710       720       730
           700       710       720       730       740       750       760

Hum.  CAGCCATCCCCTTCGACCCCAGGTCGTCTACTTCTTCTTCGAGGAGACAGCCAGCGAGTTTGACTTCTTTGA
      ::::::::: :: :::::::::::::::: ::::::::::::::::::::::::::::::::::::::::
Mur.  CAGCCATTCCATCCACCCCAGGTCGTCTATTTCTTTCTTTGAGGAGACAGCCAGCGAGTTTGACTTCTTTGA
           740       750       760       770       780       790       800
           770       780       790       800       810       820       830
```

Fig. 61C

```
         810            820           830            840           850            860           870
Hum. GAGGCTCCACACATCGCGGGTGGCTAGAGTCTGCAAGAATGACGTGGGCGGCGAAAAGCTGCTGCAGAAG
     ::: :  ::: :   ::          :::::::::::::::::::::::::::::::::::::::::::
Mur. AGAGCTGTATATATCCAGGGCTGGCTCAAGTCTGCAAGAACGACGTGGGCGGTGAAAAGCTGCTGCAGAAG
         840            850           860            870           880            890           900

880            890           900            910           920            930           940
Hum. AAGTGGACCACCTTCCTGAAGGCCCCAGCTGCTCTGCACCCAGCCGGGGCAGCTGCCCTTCAACGTCATCC
     :::::::::::::::::::: ::::::::::::::::::::::::::::::::::::::::  ::::::::
Mur. AAGTGGACCACCTTCCTCAAAGCCCCAGCTGCTCTGCGCCTCAGCCAGGGCAGCTGCCATTCAACATCATCC
         910            920           930            940           950            960           970

950            960           970            980           990            1000          1010
Hum. GCCACGCGGTCCTGCTCCCCGCCCGATTCTCTCCCACAGCTCTTCACCTCCCCAGTG
     :::::::::::::::::::::::::::::::::  ::::::::::::::::::::::
Mur. GCCACGCGGTCCTGCTCCCGCCCGATTCTCCCCTGTTTCCCGCATCTACGCAGTCTTTACCTCCCCAGTG
         980            990           1000           1010          1020           1030          1040

1020           1030          1040           1050          1060           1070          1080
Hum. GCAGGTTGGCGGGACCAGGAGCTCTGCGGTTTGTGCCTTCTCTCTTGACATTGAACGTGTCTTTAAG
     :::::::::::::::::::::::::::::::::::::::::::::::::::::::::: ::::::::
Mur. GCAGGTTGGCGGGACCAGGAGCTCAGCGGAGCTCGTGTGCCTTCTCTCTTCACGGACATTGAGCGAGTCTTTAAAA
         1050           1060          1070           1080          1090           1100          1110
```

Fig. 61D

```
           1090       1100       1110       1120       1130       1140       1150
Hum.  GGGAAATACAAAGAGTTGAACAAAGAAACTTCACGCTGGACTACTTATAGGGCCCTGAGACCAACCCCC
      ::::::  ::::::::::::::::::::::  :: ::::::::  ::::  :    ::: ::  :::
Mur.  GGGAAGTACAAGGAGCTGAACAAGGAGACCTCCCGCTGGACCACTTACCGGGGCTCAGAGGTCAGCCCGA
           1120       1130       1140       1150       1160       1170       1180

1160       1170       1180       1190       1200       1210       1220
Hum.  GGCCAGGCAGTTGCTCAGTGGGCCCCCTCTGATAAGGCCCTGACCTTCATGAAGGACCATTTCCTGAT
      :::::::::::::::::::::::::::::  :::::::::::::::::::::::::::::::::::
Mur.  GGCCAGGCAGTTGCTCCATGGGCCCCCTCCTCTGACAAAGCCTTGACCTTCATGAAGGACCATTTCTGAT
           1190       1200       1210       1220       1230       1240       1250

1230       1240       1250       1260       1270       1280       1290
Hum.  GGATGAGCAAGTGGGTGGGACGCCCCTGCTGGTGAAATCTGGCGTGGAGTATACACGGCTTGCAGTGGAG
      :::::::::::::  :::: ::::::::::::::::::::::::::::::::::::::::::::::
Mur.  GGATGAGCACGTGGTAGGACGCTGGGAACACCCCTGCTGGTGAAGTCTGGTGTGGAGTACACGGCTTGCTGTGTGGAG
           1260       1270       1280       1290       1300       1310       1320

1300       1310       1320       1330       1340       1350       1360
Hum.  ACAGCCCAGGGCCTTGATGGGCCACAGCCATCTTGTCATGTACCTGGGAACCACCAGGGTCGCTCCACA
      :::::::::::::::::::: ::::::::::::   :::::::::::: ::::::::::::::::::
Mur.  TCAGCTCGGGGCCTTGATGGGAGCAGCCATGTGTCATGTATCTGGTCATCTGGTACCTCCACGGGTCCCCTGCACA
           1330       1340       1350       1360       1370       1380       1390
```

Fig. 61E

```
              1370      1380      1390      1400      1410      1420      1430
Hum. AGGCTGTGTGGTAAGTGGGACAGCAGTGCTCATCTGGTGAAGAGATTCAGCTGTTCCCTGACCCTGAACC
     ::::::::  :  ::::::::::::::::::::::::::::::::::::::::::::::::::  ::  ::
Mur. AGGCTGTGTGGTGTGCCTCAGGACAGCAGTGCTTATCTCGTGGAGGAGATTCAGCTGAGCCCTGACTCTGAGCC
              1400      1410      1420      1430      1440      1450      1460

1440      1450      1460      1470      1480      1490      1500
Hum. TGTTCGCAACCTGCAGCTGGCCCCCCACCCAGGGTGCAGTGTTTGTAGGCTTCTCAGGAGGTGTCTGGAGG
     :::::: ::::::::::::::::::::  ::::::::::::::::::  ::::::::::::::::::::::
Mur. TGTTCGAAACCTGCAGCTGGCCCCCGCCCCAGGGTGCAGTGTTTGCAGGCTTTCTCTGGAGGCATCTGGAGA
              1470      1480      1490      1500      1510      1520      1530

1510      1520      1530      1540      1550      1560      1570
Hum. GTGCCCCGAGCCAACTGTAGTGTCTATGAGAGCTGTGTGTCCTTGCCCGGGACCCCCACTGTG
     ::  ::::::::::::::::  ::::::::  :: :::::::::::::  ::::::::::::::
Mur. GTTCCCAGGGCCAATTGCAGTGTCTACGAGAGCTGTGTGTGCTTGCCAGGGACCCTCACTGTG
              1540      1550      1560      1570      1580      1590      1600

1580      1590      1600      1610      1620      1630      1640
Hum. CCTGGGACCCTGAGTCCCGAAACCTGTTGCCTCCTGTCTGCCCCCAACCTGAACTCCTGGAAGCAGGACAT
     :::::::::::::::: ::  ::: :::::::::::::::  : :::::::::: ::  ::::::::::::
Mur. CCTGGGACCCTGAATCAAGACTCTGCGAGCCCTCGGCTC-TACCAAGCCT--TGGAAGCAGGACAT
              1610      1620      1630      1640      1650      1660      1670
```

Fig. 61F

```
Hum.  GGAGCGGGGGGAACCCAGAGTGTGGGCAATGTGCCAGTGGCCCATGAGAGCAGGAGCCTTCGGCCTCAGAGCCGC
            1650      1660      1670      1680      1690      1700      1710
       :::  ::  :::::::::::  ::  :::::::::::::  :::  :::  :::::::::::  :::::  ::
Mur.  GGAACGCGGCAACCCGGAGTGGGTATGCACCCGTGGCCCATGGCCCAGGAGCCCCCGGCGTCAGAGCCCC
            1680      1690      1700      1710      1720      1730      1740

Hum.  CCGCAAATCATTAAAGAAGTCCTGGCTGTGTCCCCAACTCCATCCTGGAGCTCCCCCTGCCCCACCTGTCAG
            1720      1730      1740      1750      1760      1770      1780
       ::  ::  ::::::::::::::::::::  ::::::::::::::::::::::::  ::::::::::::::
Mur.  CCTCAACTAATTAAAGAAGTCCTGACAGTCCCCAACTCCATCCTGGAGCTGCCCCCCACCTGTCAG
            1750      1760      1770      1780      1790      1800      1810

Hum.  CCTTGGCCTCTCTTATTATTGGAGTCATGGAGTCATGGCCCAGCAGTCCCAGAAAGCCTCTTCCACTGTCTACAATGG
            1790      1800      1810      1820      1830      1840      1850
       ::  :::::::::::::::::::  ::  :::::::::::::::  ::::::::::::::::::::::::
Mur.  CACTGGCCTCTTACCACTGGAGTCATGGCCGAGCCAAAATCTCAGAAGCCTCTGCTACCGTCTACAATGG
            1820      1830      1840      1850      1860      1870      1880

Hum.  CTCCCCTCTTGCTGATAGTGCAGGATGGAGTTGGGGGTCTCTACCAGTGCTGGGCAACTGAGAATGGCTTT
            1860      1870      1880      1890      1900      1910      1920
       :::::::::::::::  ::  :::::::::::::::::::::::::::::::::::::::::::::  ::
Mur.  CTCCCCTCTTGCTGCTGCCGCAGGATGGTGTCGGGGGCCTCTACCAGTGTGTGGCGACTGAGAACGGCTAC
            1890      1900      1910      1920      1930      1940      1950
```

Fig. 61G

```
            1930      1940      1950      1960      1970      1980      1990
Hum.   TCATACCCTGTGATCTCCTACTGGGTGGACAGCCAGGACCAGAGACCCTGGCCCTGGATCCTGAACTGGCAG
       ::::::::::::: :::::::::: ::::::: :::::::::::::::::::::::::::: :::::::
Mur.   TCATACCCTGTGTCTCCTATTGGGTAGACAGCCAGGACCAGAGCCCCCTGGCGCTGGACCCTGAGCTGGCGG
            1960      1970      1980      1990      2000      2010      2020

2000      2010      2020      2030      2040      2050      2060
Hum.   GCATCCCCCCGGGAGCATGTGAAGGTCCCCGTTGACCAGGGGTCAGTGTGGGCCCCCTGGCTGCCCCAGCA
       ::::: ::::::::::: :::: :::::: ::::::::::::::::::::::  :: :::::::::::::
Mur.   GCGTTCCCCGTGAGCGTGTGCAGGTCCCGCTGACCAGGGGTCCGCTGAGGGCGGAGCTTCCATGGCTGCCCAGCG
            2030      2040      2050      2060      2070      2080      2090

2070      2080      2090      2100      2110      2120      2130
Hum.   GTCCTACTGGGCCCCACTTTGTCACTGTCACTGTCCTCTTTGCCTTAGTGCTTTCAGGAGCCCTCATCATC
       :::::::::::::::::: ::  ::::::  :::: :::::::::::::::::::::::: :::  ::
Mur.   GTCCTACTGGGCCCCATTTTCTCATCGTCGTTACCGTGCCATGCCTCTCGGGAGTGCTCACTCTC
            2100      2110      2120      2130      2140      2150      2160

2140      2150      2160      2170      2180      2190      2200
Hum.   CTCGTGGCCTCCCCATTGAGAGCACTCCGGGCTCGGGGCAAGGTTCAGGGCTGTGAGACCCTGCGCCCTG
       :: :::::::::: :::::::::::::::::::::::::::::::::: ::::::::::::::::: :
Mur.   CTCCTCCGCTTCCCCACTGGGGGCGCTGCGGGCTCGGGGTAAGGTTCAGGGTGCCGCCCCA
            2170      2180      2190      2200      2210      2220      2230
```

Fig. 61H

```
             2210       2220       2230       2240       2250       2260       2270
Hum.  GGGAGAAGGCCCCGTTAAGCAGAGAGCAACACCTCCAGTCTCCCAAGGAATGCAGGACCTCTGCCAGTGA
      :::::::::: ::::::: :::::::::  :::: ::::::::::::::  ::::::::::::::::::
Mur.  GGGAAAAGGCTCCACTGAGCAGGACCAGCACCACCTCCAAGGACCCTCCAGCTCCAAGGACCTCTGCCAGTGA
             2240       2250       2260       2270       2280       2290       2300

2280       2290       2300       2310       2320       2330       2340
Hum.  TGTGGACGCTGACAACAACTGCCTAGGCACTGAGGTAGCTTAAACTCTAGGCACAGG--CCGGGGCTG--C
      :: :::::: :::::::::::::::::::::::::::::::::: :: :::::::::::     ::::  :
Mur.  CGTAGATGCCGACAACAACCATCTGGGCGCCGAAGTGGCTTAAACA-GGGACACAGATCCGCAGCTGAGC
             2310       2320       2330       2340       2350       2360       2370

2350       2360       2370       2380       2390       2400       2410
Hum.  GGTGCAGGCACCTGGCCATGCTGGCTGGCGGCCCAAGCACAGCCCTGACTAGGATGACAGCAGCACAAAA
      :::::::::::::::::::::: ::                    :::::::::
Mur.  AGAGCAAGCCACTGGCCCTTGGCTTGTTGGCTATGC----CAGGCACAG---------------TGCCACTCT--
             2380       2390       2400       2410       2420

2420       2430       2440       2450       2460       2470       2480
Hum.  AGACCACCTTTCTCCCCTGAGAGGAGCTTCTGCTACTCTGATGACACTGATGACACTCAGCAGGGTGATGC
      :::::       :: :::::: ::  :::  :  ::::: :  :::::: :::::::::::::::::::  :
Mur.  -GACCA-------GGGTAGGAG--GCT-CT-C-CTGCTA-ACGTGTGTCAC-CTACAG------C
              2430                      2440    2450    2460
```

Fig. 61I

```
              2490       2500       2510       2520       2530       2540       2550
Hum.  ACAGCAGTCTG-CCTCCCCTATGGGACTCCCTTCTACCAAGCACATGAGCTCTCTAACAGGGTGGGGCT
       ::  :::: :  :::::::::::::::::::::::: :::::::: ::::::::        :::::
Mur.  ACC-CAGTAGGTCCTCCCCCTGTGGGACTCTCTTCTGC-AAGCACATT-------GGGCT
         2470       2480       2490       2500       2510

2560       2570       2580       2590       2600       2610
Hum.  ACCCCCAGACCTGCTCCTACACTGATA-TTGAAGAACCTGGAGAGGATCCTTCAGTTCTGGCCATTCCAG
       :  ::::::  :: ::::::  :::::  : :::: :::::::: :: ::: ::::: ::::::::
Mur.  GTCTCCATACCTGTACTTGTGTGTGACAGGAGAAGAGCCAGAC-AGGTTTCTTTGATTTTGATTGACCCAA
         2520       2530       2540       2550       2560       2570       2580

2620       2630       2640       2650       2660       2670       2680
Hum.  GGACCCT-CCAGAAACACA-GTGTTTCAAGAGATCCTAAAAAAACCTGCCTGTCCCAGGACCCTATGGTA
       :::::: :::  :::::: :: :::::  ::: :  :::: :::::: :: :::::: ::::: :: :
Mur.  GAGCCCTGCCTGTAACAAACGTGTGGCTGTCTCT-GGGATTCTGTGGTG
         2590       2600       2610       2620       2630       2640       2650

2690       2700       2710       2720       2730       2740       2750
Hum.  ATGAACACCAAAACATCTAAACAATCATATGCTAA-CATGC---CAC--TCCTGGAAACT-CCACTCTGAA
       :  ::: :: ::: ::::  :  :: ::: :::: ::::      ::  :: ::: :::: :::::::::
Mur.  ACAAAC-CTAAGCATCCGAGCAAGCTGGGGCTATTCCTGCAAACTCCATCCTGAACGCTGTCACTCTAGA
         2660       2670       2680       2690       2700       2710       2720
```

Fig. 61J

```
Hum.      ----GCTGCCGCTTTGGACACCAACACTCCCTTCT-CCCAGG-GTCATGCAGGGATCTGCTCCTCCTGC
              :::::   ::::::::::::::::::::::::::: :: ::::::: ::::::: :::::  :: ::
Mur.      AGCAGCTGCTGCTTTGAACACCAGCGCCCACCTTCCCAAGAGTCTCTATGGAGTTGGC-CCCTTGTGT
```

Fig. 61K

```
          3020      3030      3040      3050      3060      3070      3080
Hum. AAACTGCTTGTCAGAGACTGTTTATTTTTTATTAAAAATATAAGGCTTAAAAAAAAAAAAAAAAAAA
     ::::::::::::  :::::::::::::::::::: ::::::::
Mur. AAACTGCTTGTCACAGACAATTTATTTTTTATTAAAAA-------------------AGATATAA
          3000      3010      3020                            3030

3090      3100
Hum. AAAAAAAAAG---GGGGCCGC
     ::::::::
Mur. GCTTTAAAG-----------
     3040
```

Fig. 61L

```
                  10         20         30         40         50         60
286  MCTKT-IPVLWGCFL-LWNLYVSSSQTIYPGIKARITQRALDYGVQAGMKMIEQMLKEKKLPDLSGSESL
     :: .: .. : :: . :.. .:  .  : ::.:: .   :..::..:.  :..:  :.::
BPI  MARGPCNAPRWVSLMVLVAIGTAVTAAVNPGVVVRISQKGLDYASQQGTAALQKELKRIKIPDYS--DSF
                  10         20         30         40         50         60

70         80         90        100        110        120        130
286  EFLKVDYVNYNFSNIKISAFSFPNTSLAFVPGVGIKALTNHGTANISTDWGFESPLFVLYNSFAEPME--
     :.:.  :. ::..  ::. :  :  :.: : .  :::..:  : :..  .  : :. : ..:  :
BPI  KIKHLGKGHYSFYSMDIREFQLPSSQISMVPNVGLKFSISNANIKISGKWKAQKRFLKMSGNFDLSIEGM
              70         80         90        100        110        120        130

140        150
286  -----------KPI----------------------------------LKN-LNEMLCPIIASE
                 :::                                 : : :.:. : :..:
BPI  SISADLKLGSNPTSGKPTITCSSCSSHINSVHVHISKSKVGWLIQLFHKKIESALRNKMNSQVCEKVTNS
             140        150        160        170        180        190        200

160        170        180        190        200        210        220
286  VKA-LNANLSTLEVLTKIDNYTLLDYSLISSPEITENYLDLNLKGVFYPLENLTDPPFSPVPFFVLPERSN
     : . :.:.:.: :. . .:  . ::   : :   .::.    :.:. : :  . ::  :  :. :.
BPI  VSSKLQPYFQTLPVMTKIDSVAGINYGLVAPPATTAETLDVQMKGEFYSENHHNPPPFAPPVMEFPAAHD
                  210        220        230        240        250        260        270
```

Fig. 64A

```
            230       240       250       260       270       280       290
  286  SMLYIGIAEYFFKSASFAHFTAGVFNLTLSTEEISNH--FVQNSQGLGNVLSRIAEIYILSQPFMVRIMA
       :::::::::   ::                      :::               :  ::
  BPI  RMVYLGLSDYFFNTAGLVYQEAGVLKMTLRDDMIPKESKFRLTTKFFGTFLPEVAKKFP-NMKIQIHVSA
            280       290       300       310       320       330       340

300       310       320       330       340       350       360
  286  TEPPIINLQPGNFTLDIPASIMMLTQPKNSTVETIVSMDFVASTSVGLVILGQRLVCSLSLNRFRLALPE
       ::  :   ::::  :: :                 ::  :::::       :::
  BPI  STPPHLSVQPTGLTFYPAVDVQAFAVLPNSSLASLFLIGMHTTGSMEVSAESNRLVGELKLDRLLLELKH
            350       360       370       380       390       400       410

370       380       390       400       410       420       430
  286  SNRSNIEVLRFENILSSILHFGVLPLANAKLQQGFPLPNPHKFLFVNSDIEVLEGFLLISTDLKYETSSK
       ::  :: : ::     :  ::::         :::::::      ::::::
  BPI  SNIGPFPVELLQDIMNYIVPILVLPRVNEKLQKGFPLPTPARVQLYNVVLQPHQNFLLFGADVVYK----
            420       430       440       450       460       470       480

440       450
  286  QQPSFHVWEGLNLISRQWRGKSAP

BPI  ------------------------
```

Fig. 64B

```
286  MCTKTIPVLWGCFLLWNLYVSSSQTI--YPGIKARITQRALDYGVQAGMKMIEQMLKEKKLPDLSGSESL
              :  :::::        .: :::::::::::::::::::::::::::::::::::::..:  :
RENP MGALARAL--PSILLALLLTSTPEALGANPGLVARITDKGLQYAAQEGLLALQSELLRITLPDFTG--DL
                       10        20        30        40        50        60

286  EFLKVDYVNYNFSNIKISAFSFPNTSLAFVPGVGIKALTNHGTANISTDWGFESPLFVLYNSFAEPME--
     :::::::::::::::: :::::::::::::::::::::::::::::::::::::::::::::::::
RENP RIPHVGRGRYEFHSLNIHEFQLPSSQISMVPNVGLKFSISNANIKISGKWKAQKRFLKMSGNFDLSIEGM
           70        80        90       100       110       120       130

286  -------KPI------------------------------------------LKN-LNEMLCPIIASE
            :::                                          :::  ::::::::::::
RENP SISADLKLGSNPTSGKPTITCSSCSSHINSVHVHISKSKVGWLIQLFHKKIESALRNKMNSQVCEKVTNS
          150       160       170       180       190       200

286  VKA-LNANLSTLEVLTKIDNYTLLDYSLISSPEITENYLDLNLKGVFYPLENLTDPPFSPVPFFVLPERSN
     :::  ::::::::::::::::::::::::::::::::::::::::::::::::::::::::::::::::
RENP VSSKLQPYFQTLPVMTKIDSVAGINYGLVAPPATTAETLDVQMKGEFYSENHHNPPFAPPVMEFPAAHD
          220       230       240       250       260       270

Fig. 65A
```

```
         230       240       250       260       270       280       290
286 SMLYIGIAEYFFKSASFAHFTAGVFNLTLSTEEISNH--FVQNSQGLGNVLSRIAEIYILSQPFMVRIMA
    ::  ::.: ::::..  :.: ::::::::::::::    ::::::.:::::::::::::: ::::::
RENP RMVYLGLSDYFFNTAGLVYQEAGVLKMTLRDDMIPKESKFRLTTKFFGTFLPEVAKKFP-NMKIQIHVSA
         280       290       300       310       320       330       340

300       310       320       330       340       350       360
286 TEPPIINLQPGNFTLDIPASIMMLTQPKNSTVETIVSMDFVASTSVGLVILGQRLVCSLSLNRFRLALPE
    :::: :::::::::::::::::::::::::::::::::::.::::::::::::::::::::::::::
RENP STPPHLSVQPTGLTFYPAVDVQALAVLPNSSLASLFLIGMHTTGSMEVSAESNRLVGELKLDRLLLELKH
         350       360       370       380       390       400       410

370       380       390       400       410       420       430
286 SNRSNIEVLRFENILSSILHFGVLPLANAKLQQGFPLPNPHKFLFVNSDIEVLEGFLLISTDLKYETSSK
    :: : ::.: :::::::::::::: ::::: :::.:::::::::::::.::::::::::::::::::
RENP SNIGPFPVELLQDIMNYIVPILVLPRVNEKLQKGFPLPTPARVQLYNVVLQPHQNFLLFGADVVYK---
         420       430       440       450       460       470       480

440       450
286 QQPSFHVWEGLNLLISRQWRGKSAP

RENP --------------------------
```

Fig. 65B

```
              10         20         30         40         50         60         70
294  MLETLSRQWIVSHRMEMWLLILVAYMFQRNVNSVHMPTKAVDPEAFMNISEIIQHQGYPCEEYEVATEDG
     :  :      :::      :::  :         :                            ::::::::
HLP  M------WLL----LTMASLISVLGTTHGLFGKLH----PGSPEVTMNISQMITYWGYPNEEYEVTEDG
             10         20             30         40         50         60

80         90        100        110        120        130        140
294  YILSVNRIPRGLVQPKKTGSRPVVLLQHGLVGGASNWISNLPNNSLGFILADAGFDVWMGNSRGNAWSRK
     ::::::::::  : :::::  ::::::::: ::::::::::::::: :::::: ::: :::::: :::
HLP  YILEVNRIPYGKKNSGNTGQRPVVFLQHGLLASATNWISNLPNNSLAFILADAGYDVWLGNSRGNTWARR
             70         80         90        100        110        120

150        160        170        180        190        200        210
294  HKTLSIDQDEFWAFSYDEMARFDLPAVINFILQKTGQEKIYYVGYSQGTTMGFIAFSTMPELAQKIKMYF
     :: ::: :::::::: ::::: :::::::::: ::::::::::::::::: ::::::: ::: :::
HLP  NLYYSPDSVEFWAFSFDEMAKYDLPATIDFIVKKTGQKQLHYVGHSQGTTIGFIAFSTNPSLAKRIKTFY
            130        140        150        160        170        180        190

220        230        240        250        260        270
294  ALAPIATVKHAKSPGTKFLLLPDMMIKGLFGKKEFLYQTRFLRQ-LVIYLCGQVILDQICSNIMLLGGF
     :::: ::::: ::: :::: :: ::  :: : :::::  : :  ::     : ::::::::::  :::
HLP  ALAPVATVKYTKSLINKLRFVPQSLFKFIFGDKIF-YPHNFFDQFLATEVCSREMLNLLCSNALFIICGF
            200        210        220            230        240        250        260

Fig. 66A
```

```
        280          290         300         310          320         330         340
294 NTNMNMNMSRASVYAAHTLAGTSVQNILHWSQAVNSGELRAFDWGSETKNLEKCNQPTPVRYRVRDMTVPT
    :::  ::    ::      ::::::::::    :   :    :::  :  :    ::    :  : :: ::  :
HLP DSKNFNTSRLDVYLSHNPAGTSVQNMFHWTQAVKSGKFQAYDWGSPVQNRMHYDQSQPPYYNVTAMNVPI
       270         280         290         300         310         320         330

350         360         370         380         390         400         410
294 AMWTGGGQDWLSNPEDVKMLLSEVTNLIYHKNIPEWAHVDFIWGLDAPHRMYNEIIHLMQQEETNLSQGRC
    ::  :: :::::  :  : :::    :::::::::::  : : ::: :: ::::::  :::    :
HLP AVWNGGKDLLADPQDVGLLLPKLPNLIYHKEIPFYNHLDFIWAMDAPQEVYNDIVSMISEDKK------
       340         350         360         370         380         390

420
294 EAVL

HLP ----
```

Fig. 66B

```
294  MLETLSRQWIVSHRMEMWLLILVAYMFQRNVNSVHMPTK--AVDPEAFMNISEIIQHQGYPCEEYEVATE
              :    ::: :    :::        .::       ::   :::      :::
LAL  M------------KMRFLGLVVCLVLWPLHSEGSGKLTAVDPETNMNVSEIISYWGFPSEEYLVETE

294  DGYILSVNRIPRGLVQPKKTGSRPVVLLQHGLVGGASNWISNLPNNSLGFILADAGFDVWMGNSRGNAWS
     :::::  ::::: :  .        ::::::: ::   :: ::::.:::::::: ::::::::::::
LAL  DGYILCLNRIPHGRKNHSDKGPKPVVFLQHGLLADSSNWVTNLANSSLGFILADAGFDVWMGNSRGNTWS

294  RKHKTLSIDQDEFWAFSYDEMARFDLPAVINFILQKTGQEKIYYVGYSQGTTMGFIAFSTMPELAQKIKM
     ::::::: ::::::::::::::  ::::.:::::::::::: :::::::::: :::::: :::: :::
LAL  RKHKTLSVSQDEFWAFSYDEMAKYDLPASINFILNKTGQEQVYYVGHSQGTTIGFIAFSQIPELAKRIKM

294  YFALAPIATVKHAKSPGTKFLLLPDMMIKGLFGKKEFLYQTRFLRQLVIYLCGQVILDQICSNIMLLGG
     :::::: ::. :::::  :: :::  :  ::::::::: .:::. ::::::::::: : :::::::::
LAL  FFALGPVASVAFCTSPMAKLGRLPDHLIKDLFGDKEFLPQSAFLKWLGTHVCTHVILKELCGNLCFLLCG
```

Fig. 68A

```
           280          290         300         310         320         330         340
294  FNTNMNMMSRASVVYAAHTLAGTSVQNILHWSQAVNSGELRAFDWGSETKNLEKCNQPTPVRYRVRDMTVP
     ::  :  : : :::::::::::::::::::: :: :: :  :::  :     :    ::  :: :: :::
LAL  FNERNLNMSRVDVYTTHSPAGTSVQNMLHWSQAVKFQKFQAFDWGSSAKNYFHYNQSYPPTYNVKDMLVP
           270          280         290         300         310         320         330

350          360         370         380         390         400         410
294  TAMWTGGQDWLSNPEDVKMLLSEVTNLIYHKNIPEWAHVDFIWGLDAPHRMYNEIIHLMQQEETNLSQGR
     ::  ::  ::  :   :::    ::::::: ::::::  : ::::::  :: ::   :  ::::   :
LAL  TAVWSGGHDWLADVYDVNILLTQITNLVFHESIPEWEHLDFIWGLDAPWRLYNKIINLMRKYQ------
           340          350         360         370         380         390

420
294  CEAVL
     -----
LAL  -----
```

Fig. 68B

```
296 MATLGHTFPFYAGPKPTFPMDTTLASIIMIFLTALATFIVILPGIRGKTRLFWLLRVTSLFIGAAILAV
         .  :    :    :  ::::.  :    :    :::::::::::.    :::::::.  :  :::::
CRP M-RIAH-----ASSRGNI------SIFSVFLIPLIAYILILPGVR-RKRVVTTVTYVLMLAVGGALIAS
         10           20          30         40         50         60       70

296 NFSSEWSVGQVSTNTSYKAFSSEWISADIGLQVGLGGVNITL------TGTPVQQLNETIN--YNEEFTW
    :::::    .:.      ::    ::    .  :  ::::.      ::::::::::::.  ::::::
CRP LIYPCWASGSQMIYTQFRGHSNERILAKIGVEIGLQKVNVTLKFERLLSSNDVLPGSDMTELYYNEGFDI
         80          90         100        110        120        130

296 RLGENYAEECAKALEKGLPDPVLYLAEKFT-PRSPCGLYRQYRLAGHYTSAMLWVAFLCWLLANV-MLSM
      :::::    ::    :: ::::::      :::::::::::::::::::::::::::::::  ::::
CRP SGISSMAEALHHGLENGLPYPMLSVLEYFSLNQDSFDWGRHYRVAGHYTHAAIWFAFACWCLSVVLMLFL
         140        150        160        170        180        190        200

296 PVLVYGGYMLLATGIFQLLALLFFSMATSLTSPCPLHL---GASVLHTHHGPAF----WITLTTGLLCVL
    :: :  :  :::::    :::::    ::::::::::   :::::::::::::    ::::::::::::
CRP PHNAYKS--ILATGISCLIACLVYL---LLSPCELRIAFTGENFERVDLTATFSFCFYLIFAIGILCVL
         210        220        230        240        250        260
```

Fig. 70A

```
            270       280       290       300       310       320
296  LGLAMAVAHRMQPHRLKAFFNQSVDEDPMLEW------SPEEGLLSPRY--RSMADSPKSQDIPLSEAS
     ::: :   :      :  :   :   ::.::      : ::: :::    :.: .: :  :  :::
CRP  CGLGLGICEHWRIYTLSTFLDASLDEHVGPKWKKLPTGGPALQGVQIGAYGTNTTNSSRDKNDISSDKTA
            270       280       290       300       310       320       330

330
296  STKAY-----CK-------EAHPKDPD---------CA---L
     ..      .  :       :   :  :         .:
CRP  GSSGFQSRTSTCQSSASSASLRSQSSIETVHDEAELERTHVHFLQEPCSSSST
            340       350       360       370       380
```

Fig. 70B

ANTI-TANGO294 ANTIBODIES AND USES THEREOF

CROSS-REFERENCE TO RELATED APPLICATIONS

This application is a continuation-in-part of U.S. application Ser. No. 09/479,249, filed on Jan. 7, 2000, now abandoned, and a continuation-in-part of U.S. application Ser. No. 09/559,497, filed on Apr. 27, 2000, now abandoned.

This application is also a continuation-in-part of U.S. application Ser. No. 09/578,063, filed on May 24, 2000, now U.S. Pat. No. 6,764,677 which is a continuation-in-part of U.S. application Ser. No. 09/333,159, filed on Jun. 14, 1999, now U.S. Pat. No. 7,033,780.

This application is also a continuation-in-part of U.S. application Ser. No. 09/596,194, filed on Jun. 16, 2000, now abandoned, which is a continuation-in-part of U.S. application Ser. No. 09/342,364, filed on Jun. 29, 1999, now abandoned.

This application is also a continuation-in-part of U.S. application Ser. No. 09/608,452, filed on Jun. 30, 2000, now abandoned, which is a continuation-in-part of U.S. application Ser. No. 09/393,996, filed on Sep. 10, 1999, now abandoned.

This application is also a continuation-in-part of U.S. application Ser. No. 09/602,871, filed on Jun. 23, 2000, which is a continuation-in-part of U.S. application Ser. No. 09/420,707, filed on Oct. 19, 1999, now abandoned.

Each of the applications cross-referenced in this section are incorporated into this disclosure by reference in their entirety.

STATEMENT REGARDING FEDERAL RESEARCH SUPPORT

Not Applicable

REFERENCE TO MICROFICHE APPENDIX

Not Applicable

BACKGROUND OF THE INVENTION

The molecular bases underlying many human and animal physiological states (e.g., diseased and homeostatic states of various tissues) remain unknown.

Nonetheless, it is well understood that these states result from interactions among the proteins and nucleic acids present in the cells of the relevant tissues. In the past, the complexity of biological systems overwhelmed the ability of practitioners to understand the molecular interactions giving rise to normal and abnormal physiological states. More recently, though, the techniques of molecular biology, transgenic and null mutant animal production, computational biology, and pharmacogenomics have enabled practitioners to discern the role and importance of individual genes and proteins in particular physiological states.

Knowledge of the sequences and other properties of genes (particularly including the portions of genes encoding proteins) and the proteins encoded thereby enables the practitioner to design and screen agents which will affect, prospectively or retrospectively, the physiological state of an animal tissue in a favorable way. Such knowledge also enables the practitioner, by detecting the levels of gene expression and protein production, to diagnose the current physiological state of a tissue or animal and to predict such physiological states in the future. This knowledge furthermore enables the practitioner to identify and design molecules which bind with the polynucleotides and proteins, in vitro, in vivo, or both.

Cadherins are a class of cell-surface adhesion molecules that mediate calcium-dependent cell-to-cell adhesion. Many cadherins exhibit homophilic adhesion; i.e. they bind with molecules of the same cadherin on a different cell.

However, cadherins that bind specifically with other molecules have also been described (e.g. Telo et al., 1998, J. Biol. Chem. 273:17565-17572; Ludviksson et al., 1999 J. Immunol. 162:4975-4982). In addition to their binding capabilities, cadherins also exhibit transmembrane signaling and regulatable adhesion activity (e.g. Yap et al., 1997, 13:119-146; Gumbiner, 2000, J. Cell Biol. 148:399-403). Despite the fact that numerous cadherins and cadherin-like proteins have been described, many others have not yet been characterized. A family of cadherin-like proteins which the inventor believes to be novel is described herein.

Many secreted proteins, for example, cytokines and cytokine receptors, play a vital role in the regulation of cell growth, cell differentiation, and a variety of specific cellular responses. A number of medically useful proteins, including erythropoietin, granulocyte-macrophage colony stimulating factor, human growth hormone, and various interleukins, are secreted proteins. Thus, an important goal in the design and development of new therapies is the identification and characterization of secreted and transmembrane proteins and the genes which encode them.

Many secreted proteins are receptors which bind a ligand and transduce an intracellular signal, leading to a variety of cellular responses. The identification and characterization of such a receptor enables one to identify both the ligands which bind to the receptor and the intracellular molecules and signal transduction pathways associated with the receptor, permitting one to identify or design modulators of receptor activity, e.g., receptor agonists or antagonists and modulators of signal transduction.

SUMMARY OF THE INVENTION

The present invention is based, at least in part, on the discovery of human cDNA molecules which encode proteins which are herein designated TANGO 202, TANGO 210, INTERCEPT 217, TANGO 229, TANGO 234, TANGO 265, TANGO 276, TANGO 286, INTERCEPT 289, TANGO 292, TANGO 294, INTERCEPT 296, INTERCEPT 297, INTERCEPT 309, TANGO 331, TANGO 332, TANGO 366, INTERCEPT 394, INTERCEPT 400, TANGO 416, MANGO 419, INTERCEPT 429, and TANGO 457. These proteins, fragments thereof, derivatives thereof, and variants thereof are collectively referred to herein as the polypeptides of the invention or the proteins of the invention. Nucleic acid molecules encoding polypeptides of the invention are collectively referred to as nucleic acids of the invention.

The nucleic acids and polypeptides of the present invention are useful as modulating agents for regulating a variety of cellular processes. Accordingly, in one aspect, the present invention provides isolated nucleic acid molecules encoding a polypeptide of the invention or a biologically active portion thereof. The present invention also provides nucleic acid molecules which are suitable as primers or hybridization probes for the detection of nucleic acids encoding a polypeptide of the invention.

The invention includes fragments of any of the nucleic acids described herein wherein the fragment retains a biological or structural function by which the full-length nucleic acid is characterized (e.g., an activity, an encoded protein, or a binding capacity). The invention furthermore includes fragments of any of the nucleic acids described herein wherein the fragment has a nucleotide sequence sufficiently (e.g., 50%, 60%, 70%, 80%, 85%, 90%, 95%, 98%, or 99% or greater) identical to the nucleotide sequence of the corresponding full-length nucleic acid that it retains a biological or structural function by which the full-length nucleic acid is characterized (e.g., an activity, an encoded protein, or a binding capacity).

The invention includes fragments of any of the polypeptides described herein wherein the fragment retains a biological or structural function by which the full-length polypeptide is characterized (e.g., an activity or a binding capacity). The invention furthermore includes fragments of any of the polypeptides described herein wherein the fragment has an amino acid sequence sufficiently (e.g., 50%, 60%, 70%, 80%, 85%, 90%, 95%, 98%, or 99% or greater) identical to the amino acid sequence of the corresponding full-length polypeptide that it retains a biological or structural function by which the full-length polypeptide is characterized (e.g., an activity or a binding capacity).

The invention also features nucleic acid molecules which are at least 40% (or 50%, 60%, 70%, 80%, 90%, 95%, or 98%) identical to the nucleotide sequence of any of SEQ ID NOs: 1, 2, 31, 32, 51, 52, 71, 72, 81, 82, 91, 92, 96, 97, 101, 102, 106, 107, 111, 112, 121, 122, 141, 142, 151, 152, 161, 162, 171, 172, 181, 182, 191, 192, 201, 202, 215, 217, 221, 222, 241, 242, 251, 252, 271, 272, 279, 280, 303, 304, 308, 309, 324, 325, 329, 330, 351, 352, 362, 371, 372, 379, 380, 387, 388, 403, 404, 415, 416, 423, 424, 437, and 438, the TANGO 202 nucleotide sequence of the cDNA insert of a clone deposited on Apr. 21, 1999 with the ATCC® as accession no. 207219, the TANGO 202 nucleotide sequence of the cDNA insert of a clone deposited on Apr. 21, 1999 with the ATCC® as accession no. 207221, the TANGO 210 nucleotide sequence of the cDNA insert of a clone deposited on Jul. 29, 1999 with the ATCC® as accession no. PTA-438, the INTERCEPT 217 nucleotide sequence of the cDNA insert of a clone deposited on May 28, 1999 with the ATCC® as accession no. PTA-147, the TANGO 229 nucleotide sequence of the cDNA insert of a clone deposited on Oct. 1, 1999 with the ATCC® as accession no. PTA-295, the TANGO 234 nucleotide sequence of the cDNA insert of a clone deposited on Apr. 2, 1999 with the ATCC® as accession no. 207184, the TANGO 265 nucleotide sequence of the cDNA insert of a clone deposited on Apr. 28, 1999 with the ATCC® as accession no. 207228, the TANGO 276 nucleotide sequence of the cDNA insert of a clone deposited on May 28, 1999 with the ATCC® as accession no. PTA-150, the TANGO 286 nucleotide sequence of the cDNA insert of a clone deposited on Apr. 21, 1999 with the ATCC® as accession no. 207220, the INTERCEPT 289 nucleotide sequence of the cDNA insert of a clone deposited on Oct. 1, 1999 with the ATCC® as accession no. PTA-295, the TANGO 292 nucleotide sequence of the cDNA insert of a clone deposited on Apr. 28, 1999 with the ATCC® as accession no. 207230, the TANGO 294 nucleotide sequence of the cDNA insert of a clone deposited on Apr. 21, 1999 with the ATCC® as accession no. 207220, the INTERCEPT 296 nucleotide sequence of the cDNA insert of a clone deposited on Apr. 21, 1999 with the ATCC® as accession no. 207220, the INTERCEPT 297 nucleotide sequence of the cDNA insert of a clone deposited on May 28, 1999 with the ATCC® as accession no. PTA-147, the INTERCEPT 309 nucleotide sequence of the cDNA insert of a clone deposited on Jan. 6, 2000 with the ATCC® as accession no. PTA-156, the TANGO 331 nucleotide sequence of the cDNA insert of a clone deposited on May 28, 1999 with the ATCC® as accession no. PTA-147, the TANGO 332 nucleotide sequence of the cDNA insert of a clone deposited on May 28, 1999 with the ATCC® as accession no. PTA-151, the TANGO 366 nucleotide sequence of the cDNA insert of a clone deposited on Jul. 23, 1999 with the ATCC® as accession no. PTA-424, the INTERCEPT 394 nucleotide sequence of the cDNA insert of a clone deposited on Jul. 23, 1999 with the ATCC® as accession no. PTA-424, the INTERCEPT 400 nucleotide sequence of the cDNA insert of a clone deposited on Jul. 29, 1999 with the ATCC® as accession no. PTA-438, the TANGO 416 nucleotide sequence of the cDNA insert of a clone deposited on Apr. 26, 1999 with the ATCC® as accession no. PTA-1764, the MANGO 419 nucleotide sequence of the cDNA insert of a clone deposited on Jan. 6, 2000 with the ATCC® as accession no. PTA-1156, the INTERCEPT 429 nucleotide sequence of the cDNA insert of a clone deposited on Aug. 5, 1999 with the ATCC® as accession no. PTA-455, the TANGO 457 nucleotide sequence of the cDNA insert of a clone deposited on Oct. 1, 1999 with the ATCC® as accession no. PTA-817, or a complement thereof. These deposited nucleotide sequences are hereafter individually and collectively referred to as "the nucleotide sequence of any of the clones deposited as ATCC® Accession numbers 207184, 207219, 207220, 207221, 207228, 207230, PTA-147, PTA-150, PTA-151, PTA-295, PTA-424, PTA-438, PTA-455, PTA-817, PTA-1156, and PTA-1764."

The invention features nucleic acid molecules which include a fragment of at least 15 (25, 40, 60, 80, 100, 150, 200, 250, 300, 350, 400, 450, 500, 600, 700, 800, 900, 1000, 1200, 1400, 1600, 1800, 2000, 2200, 2400, 2600, 2800, 3000, 3500, 4000, 4500, 5000, or more) consecutive nucleotide residues of any of SEQ ID NOs: 1, 2, 31, 32, 51, 52, 71, 72, 81, 82, 91, 92, 96, 97, 101, 102, 106, 107, 111, 112, 121, 122, 141, 142, 151, 152, 161, 162, 171, 172, 181, 182, 191, 192, 201, 202, 215, 217, 221, 222, 241, 242, 251, 252, 271, 272, 279, 280, 303, 304, 308, 309, 324, 325, 329, 330, 351, 352, 362, 371, 372, 379, 380, 387, 388, 403, 404, 415, 416, 423, 424, 437, 438, and the nucleotide sequence of any of the clones deposited as ATCC® Accession numbers 207184, 207219, 207220, 207221, 207228, 207230, PTA-147, PTA-150, PTA-151, PTA-295, PTA-424, PTA-438, PTA-455, PTA-817, PTA-1156, and PTA-1764, or a complement thereof.

The invention also features nucleic acid molecules which include a nucleotide sequence encoding a protein having an amino acid sequence that is at least 50% (or 60%, 70%, 80%, 90%, 95%, or 98%) identical to the amino acid sequence of any of SEQ ID NOs: 3-8, 33, 35, 38, 53-60, 73-78, 83-85, 93-95, 98-100, 103-105, 108-110, 113-115, 123-131, 143-145, 153-160, 163, 173-175, 183-185, 193-198, 203-214, 216, 223-236, 243-252, 253, 273-278, 281-302, 305-307, 310-315, 326-328, 331-333, 353-358, 363-368, 373-378, 381-386, 389-394, 405-414, 417-422, 425-436, and 439, or the amino acid sequence encoded by the nucleotide sequence of any of the clones deposited as ATCC® Accession numbers 207184, 207219, 207220, 207221, 207228, 207230, PTA-147, PTA-150, PTA-151, PTA-295, PTA-424, PTA-438, PTA-455, PTA-817, PTA-1156, and PTA-1764 or a complement thereof.

In certain embodiments, the nucleic acid molecules have the nucleotide sequence of any of SEQ ID NOs: 1, 2, 31, 32, 51, 52, 71, 72, 81, 82, 91, 92, 96, 97, 101, 102, 106, 107, 111, 112, 121, 122, 141, 142, 151, 152, 161, 162, 171, 172, 181, 182, 191, 192, 201, 202, 215, 217, 221, 222, 241, 242, 251, 252, 271, 272, 279, 280, 303, 304, 308, 309, 324, 325, 329, 330, 351, 352, 362, 371, 372, 379, 380, 387, 388, 403, 404, 415, 416, 423, 424, 437, 438, and the nucleotide sequence of any of the clones deposited as ATCC® Accession numbers 207184, 207219, 207220, 207221, 207228, 207230, PTA- 147, PTA-150, PTA-151, PTA-295, PTA-424, PTA-438, PTA-455, PTA-817, PTA-1156, and PTA-1764.

Also within the invention are nucleic acid molecules which encode a fragment of a polypeptide having the amino acid sequence of any of SEQ ID NOs: 3-8, 33, 35, 38, 53-60, 73-78, 83-85, 93-95, 98-100, 103-105, 108-110, 113-115, 123-131, 143-145, 153-160, 163, 173-175, 183-185, 193-198, 203-214, 216, 223-236, 243-252, 253, 273-278, 281-302, 305-307, 310-315, 326-328, 331-333, 353-358, 363-368, 373-378, 381-386, 389-394, 405-414, 417-422, 425-436, and 439, the fragment including at least 10 (12, 15, 20, 25, 30, 40, 50, 75, 100, 125, 150, 200, 250, 300, 400, 500, 750, 1000 or more) consecutive amino acid residues of any of SEQ ID NOs: 3-8, 33, 35, 38, 53-60, 73-78, 83-85, 93-95, 98-100, 103-105, 108-110, 113-115, 123-131, 143-145, 153-160, 163, 173-175, 183-185, 193-198,203-214, 216, 223-236, 243-252, 253, 273-278, 281-302, 305-307, 310-315, 326-328, 331-333, 353-358, 363-368, 373-378, 381-386, 389-394, 405-414, 417-422, 425-436, and 439.

The invention includes nucleic acid molecules which encode a naturally occurring allelic variant of a polypeptide comprising the amino acid sequence of any of SEQ ID NOs: 3-8, 33, 35, 38, 53-60, 73-78, 83-85, 93-95, 98-100, 103-105, 108-110, 113-115, 123-131, 143-145, 153-160, 163, 173-175, 183-185, 193-198, 203-214, 216, 223-236, 243-252, 253, 273-278, 281-302, 305-307, 310-315, 326-328, 331-333, 353-358, 363-368, 373-378, 381-386, 389-394, 405-414, 417-422, 425-436, and 439, wherein the nucleic acid molecule hybridizes under stringent conditions to a nucleic acid molecule having a nucleic acid sequence of any of SEQ ID NOs: 1, 2, 31, 32, 51, 52, 71, 72, 81, 82, 91, 92, 96, 97, 101, 102, 106, 107, 111, 112, 121, 122, 141, 142, 151, 152, 161, 162, 171, 172, 181, 182, 191, 192, 201, 202, 215, 217, 221, 222, 241, 242, 251, 252, 271, 272, 279, 280, 303, 304, 308, 309, 324, 325, 329, 330, 351, 352, 362, 371, 372, 379, 380, 387, 388, 403, 404, 415, 416, 423, 424, 437, 438, and the nucleotide sequence of any of the clones deposited as ATCC® Accession numbers 207184, 207219, 207220, 207221, 207228, 207230, PTA-147, PTA-150, PTA-151, PTA-295, PTA-424, PTA-438, PTA-455, PTA-817, PTA-1156, and PTA-1764, or a complement thereof.

Also within the invention are isolated polypeptides or proteins having an amino acid sequence that is at least about 50%, preferably 60%, 75%, 90%, 95%, or 98% identical to the amino acid sequence of any of SEQ ID NOs: 3-8, 33, 35, 38, 53-60, 73-78, 83-85, 93-95, 98-100, 103-105, 108-110, 113-115, 123-131, 143-145, 153-160, 163, 173-175, 183-185, 193-198, 203-214, 216, 223-236, 243-252, 253, 273-278, 281-302, 305-307, 310-315, 326-328, 331-333, 353-358, 363-368, 373-378, 381-386, 389-394, 405-414, 417-422, 425-436, and 439.

Also within the invention are isolated polypeptides or proteins which are encoded by a nucleic acid molecule having a nucleotide sequence that is at least about 40%, preferably 50%, 60%, 75%, 85%, or 95% identical the nucleic acid sequence encoding any of SEQ ID NOs: 3-8, 33, 35, 38, 53-60, 73-78, 83-85, 93-95, 98-100, 103-105, 108-110, 113-115, 123-131, 143-145, 153-160, 163, 173-175, 183-185, 193-198, 203-214, 216, 223-236, 243-252, 253, 273-278, 281-302, 305-307, 310-315, 326-328, 331-333, 353-358, 363-368, 373-378, 381-386, 389-394, 405-414, 417-422, 425-436, and 439, and isolated polypeptides or proteins which are encoded by a nucleic acid molecule consisting of the nucleotide sequence which hybridizes under stringent hybridization conditions to a nucleic acid molecule having the nucleotide sequence of any of SEQ ID NOs: 1, 2, 31, 32, 51, 52, 71, 72, 81, 82, 91, 92, 96, 97, 101, 102, 106, 107, 111, 112, 121, 122, 141, 142, 151, 152, 161, 162, 171, 172, 181, 182, 191, 192, 201, 202, 215, 217, 221, 222, 241, 242, 251, 252, 271, 272, 279, 280, 303, 304, 308, 309, 324, 325, 329, 330, 351, 352, 362, 371, 372, 379, 380, 387, 388, 403, 404, 415, 416, 423, 424, 437, 438, and the nucleotide sequence of any of the clones deposited as ATCC® Accession numbers 207184, 207219, 207220, 207221, 207228, 207230, PTA-147, PTA-150, PTA-151, PTA-295, PTA-424, PTA-438, PTA-455, PTA-817, PTA-1156, and PTA-1764.

Also within the invention are polypeptides which are naturally occurring allelic variants of a polypeptide that includes the amino acid sequence of any of SEQ ID NOs: 3-8, 33, 35, 38, 53-60, 73-78, 83-85, 93-95, 98-100, 103-105, 108-110, 113-115, 123-131, 143-145, 153-160, 163, 173-175, 183-185, 193-198, 203-214, 216, 223-236, 243-252, 253, 273-278, 281-302, 305-307, 310-315, 326-328, 331-333, 353-358, 363-368, 373-378, 381-386, 389-394, 405-414, 417-422, 425-436, and 439, wherein the polypeptide is encoded by a nucleic acid molecule which hybridizes under stringent conditions to a nucleic acid molecule having the nucleotide sequence of any of SEQ ID NOs: 1, 2, 31, 32, 51, 52, 71, 72, 81, 82, 91, 92, 96, 97, 101, 102, 106, 107, 111, 112, 121, 122, 141, 142, 151, 152, 161, 162, 171, 172, 181, 182, 191, 192, 201, 202, 215, 217, 221, 222, 241, 242, 251, 252, 271, 272, 279, 280, 303, 304, 308, 309, 324, 325, 329, 330, 351, 352, 362, 371, 372, 379, 380, 387, 388, 403, 404, 415, 416, 423, 424, 437, 438, and the nucleotide sequence of any of the clones deposited as ATCC® Accession numbers 207184, 207219, 207220, 207221, 207228, 207230, PTA-147, PTA-150, PTA-151, PTA-295, PTA-424, PTA-438, PTA-455, PTA-817, PTA-1156, and PTA-1764, or a complement thereof.

The invention also features nucleic acid molecules that hybridize under stringent conditions to a nucleic acid molecule having the nucleotide sequence of any of SEQ ID NOs: 1, 2, 31, 32, 51, 52, 71, 72, 81, 82, 91, 92, 96, 97, 101, 102, 106, 107, 111, 112, 121, 122, 141, 142, 151, 152, 161, 162, 17.1, 172, 181, 182, 191, 192, 201, 202, 215, 217, 221, 222, 241, 242, 251, 252, 271, 272, 279, 280, 303, 304, 308, 309, 324, 325, 329, 330, 351, 352, 362, 371, 372, 379, 380, 387, 388, 403, 404, 415, 416, 423, 424, 437, 438, and the nucleotide sequence of any of the clones deposited as ATCC® Accession numbers 207184, 207219, 207220, 207221, 207228, 207230, PTA-147, PTA-150, PTA-151, PTA-295, PTA-424, PTA-438, PTA-455, PTA-817, PTA-1156, and PTA-1764, or a complement thereof. In some embodiments, the isolated nucleic acid molecules encode a cytoplasmic, transmembrane, extracellular, or other domain of a polypeptide of the invention. In other embodiments, the invention provides an isolated nucleic acid molecule which is antisense to the coding strand of a nucleic acid of the invention.

Another aspect of the invention provides vectors, e.g., recombinant expression vectors, comprising a nucleic acid molecule of the invention. In another embodiment, the invention provides isolated host cells, e.g., mammalian or non-mammalian cells, containing such a vector or a nucleic acid of the invention. The invention also provides methods for producing a polypeptide of the invention by culturing, in a suitable medium, a host cell of the invention containing a recombinant expression vector encoding a polypeptide of the invention such that the polypeptide of the invention is produced.

Another aspect of this invention features isolated or recombinant proteins and polypeptides of the invention. Preferred proteins and polypeptides possess at least one biological activity possessed by the corresponding naturally-occurring human polypeptide. An activity, a biological activity, and a functional activity of a polypeptide of the invention refers to an activity exerted by a protein or polypeptide of the invention on a responsive cell as determined in vivo, or in vitro, according to standard techniques. Such activities can be a direct activity, such as an association with or an enzymatic activity exerted on a second protein or an indirect activity, such as a cellular processes mediated by interaction of the protein with a second protein.

The observations that expression of TANGO 416 protein is up-regulated in porcine endothelial cells, that TANGO 416 is a member of the cadherin family of proteins, and that at least one cadherin (designated E-cadherin), which is expressed in endothelial cells, binds to integrin $\alpha E\beta 7$ indicate that TANGO 416 protein can also bind with integrin $\alpha E\beta 7$. Thus, TANGO 416 nucleic acids, proteins, compounds which modulate their activity, expression, or both, and compounds (e.g., antibodies) which bind with TANGO 416 proteins (collectively "TANGO 416-related molecules") can modulate one or more of growth, proliferation, survival, differentiation, activity, morphology, and movement/migration of, for example, cells (e.g. endothelial cells) which normally express TANGO 416 and cells (e.g. certain T cells, eosinophils, mast cells, and other lymphocytes) which normally express integrin $\alpha E\beta 7$.

The ability of TANGO 416 to bind with integrin $\alpha E\beta 7$ indicates that TANGO 416 protein and other TANGO 416-related molecules can be used to modulate the physiological activities associated with integrin $\alpha E\beta 7$ function and to treat disorders to which such physiological activities contribute. TANGO 416 protein can thus be involved in disorders which affect epithelial and lymphocytic tissues. Such disorders include cell proliferation disorders, disorders associated with aberrant epithelial permeability, auto-, hypo-, and hyper-immune disorders, disorders associated with aberrant binding or adhesion of cells with other cells, and inflammatory disorders.

TANGO 416-related molecules can be used to prognosticate, prevent, diagnose, or treat one or more such disorders.

The present invention is based, at least in part, on the discovery of cDNA molecules which encode TANGO 457 proteins, which are transmembrane proteins with one or more immunoglobulin domains and which are encoded by sequences expressed in at least, uterus, fetal liver, fetal spleen, and placenta tissues.

The biological activities of TANGO 457 and modulators thereof include, e.g., (1) the ability to form, e.g., stabilize, promote, inhibit, or disrupt, protein-protein interactions (e.g., homophilic and/or heterophilic) with proteins in the signaling pathway of the naturally-occurring polypeptide; (2) the ability to bind a ligand of the naturally-occurring polypeptide; and (3) the ability to interact with a TANGO 457 receptor. Other activities include the ability to modulate function, survival, morphology, migration, proliferation and/or differentiation of cells of tissues (e.g., uterus, fetal liver, fetal spleen, and placenta) in which it is expressed.

TANGO 229, compounds which modulate its activity, expression, or both, and compounds which interact with TANGO 229 can exhibit the ability to affect one or more of growth, proliferation, survival, differentiation, activity, morphology, and movement/migration of, for example, T cells and cells of heart, liver, pancreas, placenta, brain lung, skeletal muscle, kidney, spleen, lymph node, peripheral blood leukocyte, bone marrow, and thymus tissues. TANGO 229 protein can be involved in mediating cell binding and adhesion, including binding/adhesion of cells with other cells, with extracellular matrix, and with foreign materials. TANGO 229 protein can thus have a role in disorders associated with aberrant binding of these types. TANGO 229 protein can also be involved in mediating attraction and repulsion of cells and translocation of cells through, past, or along other cells or tissues. TANGO 229 protein can furthermore be involved in transducing signals across the cell membrane.

INTERCEPT 289, compounds which modulate its activity, expression, or both, and compounds which interact with INTERCEPT 289 can exhibit the ability to affect one or more of growth, proliferation, survival, differentiation, activity, morphology, and movement/migration of, for example, lymphocytes such as monocytes and macrophages. INTERCEPT 289 protein can be involved in activating one or more types of macrophages and monocytes, and thus can be involved in one or more immune disorders and other types of disorders mediated by monocytes and macrophages.

INTERCEPT 309, compounds which modulate its activity, expression, or both, and compounds which interact with INTERCEPT 309 modulate one or more of growth, proliferation, survival, differentiation, activity, morphology, and movement/migration of cells of brain, liver, colon, prostate, kidneys, thyroid, and other epithelial and endothelial tissues. INTERCEPT 309 is a claudin-like protein, and can modulate tight-junction regulated intercellular and paracellular diffusion. INTERCEPT 309 also can participate in cell-to-cell adhesive mechanisms that do not necessarily involve tight junction formation. In addition, INTERCEPT 309 can mediate interaction of cells in which it is expressed with *Clostridium perfringens* enterotoxin, and can thus be involved in disorders mediated by *C. perfringens* and other pathogens. Furthermore, INTERCEPT 309 is associated with normal and aberrant apoptosis, and thus with disorders associated with aberrant apoptosis.

MANGO 419, compounds which modulate its activity, expression, or both, and compounds which interact with MANGO 419 can modulate one or more of growth, proliferation, survival, differentiation, activity, morphology, and movement/migration of, for example, cells of embryonic and mammary, prostate, and other epithelial and endothelial tissues. MANGO 419 protein can be involved in disorders which affect epithelial and endothelial tissues. Such disorders include cell proliferation disorders, disorders associated with aberrant epithelial/endothelial permeability, and disorders associated with aberrant binding or adhesion of cells with other cells, with extracellular matrix, or with foreign materials.

INTERCEPT 429, compounds which modulate its activity, expression, or both, and compounds which interact with INTERCEPT 429 can modulate one or more of growth, proliferation, survival, differentiation, activity, morphology, and movement/migration of, for example, cells of cardiac muscle, small intestine, and one or more of fetal lung, testis, and B cell tissues. INTERCEPT 429 can be involved in modulating growth, proliferation, survival, differentiation, and activity of cells of these tissues, in both normal and diseased tissues.

TANGO 210, compounds which modulate its activity, expression, or both, and compounds which interact with TANGO 210 exhibit the ability to affect one or more of growth, proliferation, survival, differentiation, activity, morphology, and movement/migration of, for example, human adult kidney, fetal kidney, skin, and bone marrow cells and tissues. TANGO 210 modulates the structure of extracellular matrix within, or in fluid communication with, one or more of these tissues. For example, TANGO 210 exhibits proteinase activity that can enzymatically degrade one or more of the proteinaceous components of extracellular matrix. Thus, TANGO 210-related molecules can be used to prognosticate, prevent, diagnose, or treat disorders relating to aberrant formation or degradation of extracellular matrix. In various embodiments, for example, TANGO 210 is used to prognosticate, prevent, diagnose, or treat kidney, bone marrow, and skin disorders. TANGO 210 can also be used to prognosticate, prevent, diagnose, or treat one or more cancers, including metastatic cancers.

TANGO 366, compounds which modulate its activity, expression, or both, and compounds which interact with TANGO 366 modulate one or more of growth, proliferation, survival, differentiation, activity, morphology, and movement/migration of human fibroblast cells and tissues in which fibroblasts normally or aberrantly occur. TANGO 366 is a cell surface protein-binding protein. TANGO 366 modulates binding of a cell which expresses it with one or more of an extracellular fluid protein, a protein component of the extracellular matrix, a surface protein another cell of the same animal, and a surface protein of a bacterium, fungus, or virus. TANGO 366 is therefore involved in cell-to-cell adhesion, tissue and extracellular matrix invasivity of cells, infectivity of cells by pathogens such as bacteria and viruses, endocrine signaling processes, tissue developmental and organizational processes, and the like.

INTERCEPT 394, compounds which modulate its activity, expression, or both, and compounds which interact with INTERCEPT 394 modulate one or more of growth, proliferation, survival, differentiation, activity, morphology, and movement/migration of, for example, human adult and fetal kidney cells and tissues. INTERCEPT 394, a transmembrane protein, is involved in modulation of intracellular processes, including modulation that is effected upon binding of a ligand to an extracellular portion of INTERCEPT 394. INTERCEPT 394 protein is thus capable of transmitting signals across a membrane (e.g., from a signal source outside the cell to a molecule within the cell or from a signal source within the cell to a molecule outside the cell), along a membrane (i.e., between two or more molecules on a single side of a membrane), and combinations thereof. INTERCEPT 394 protein is also capable of interacting with other membrane-associated proteins to form complexes, the activity or specificity of which can be affected by association of INTERCEPT 394 therewith.

INTERCEPT 400, compounds which modulate its activity, expression, or both, and compounds which interact with INTERCEPT 400 modulate one or more of growth, proliferation, survival, differentiation, activity, morphology, and movement/migration of, for example, human adult and fetal keratinocytes and brain cells and tissues. INTERCEPT 400 is a transmembrane protein that is involved in modulating interactions between membrane components and cellular cytoskeletons, such as interactions involved in activation of leukocytes, interactions involved in affecting cellular metabolism, interactions involved in cellular growth, and interactions involved in cellular proliferation.

INTERCEPT 217 polypeptides, nucleic acids, and modulators thereof exhibit the ability to affect growth, proliferation, survival, differentiation, and activity of human pancreas, skeletal muscle, heart, brain, placenta, lung, liver, and kidney cells. INTERCEPT 217 modulates cellular binding to one or more mediators, modulates activity and release of one or more pancreatically secreted digestive enzymes, and protects tissue from endogenous digestive enzymes. INTERCEPT 217 polypeptides, nucleic acids, and modulators thereof can be used to prevent, diagnose, or treat disorders relating to aberrant endogenous digestive enzyme activity, inappropriate interaction (or non-interaction) of cells with mediators, inappropriate cellular development and proliferation, inappropriate inflammation, and inappropriate immune responses.

INTERCEPT 297 polypeptides, nucleic acids, and modulators thereof exhibit the ability to affect growth, proliferation, survival, differentiation, and activity of human fetal cells and spleen cells and of (e.g., bacterial or fungal) cells and viruses which infect humans. Furthermore, INTERCEPT 297 modulates organization, structure, and function of biological membranes. INTERCEPT 297 polypeptides, nucleic acids, and modulators thereof can be used to affect development and persistence of atherogenesis and arteriosclerosis, for example, or to modulate transmembrane transport processes such as ion transport across neuronal and muscle cell membranes.

TANGO 276 polypeptides, nucleic acids, and modulators thereof modulate growth, proliferation, survival, differentiation, and activity of human heart, placenta, brain, lung, liver, skin, kidney, pancreas, spleen, and fetal tissues. TANGO 276 guides neuronal growth and development and modulates growth, homeostasis, and regeneration of other epithelial tissues. TANGO 276 is a secreted protein which mediates cellular interaction with cells, molecules, and structures (e.g., extracellular matrix) in the extracellular environment. TANGO 276 is involved in growth, organization, migration, and adhesion of tissues and the cells which constitute those tissues. Furthermore, TANGO 276 modulates growth, proliferation, survival, differentiation, and activity of neuronal cells and immune system cells.

TANGO 292 polypeptides, nucleic acids, and modulators thereof modulate growth, proliferation, survival, differentiation, and activity of human keratinocytes, including embryonic keratinocytes. TANGO 292, a transmembrane protein, is also involved in binding and uptake of calcium and other metal ions, and in responses of cells which express it to the presence and uptake of such ions. TANGO 292 polypeptides, nucleic acids, and modulators can be used to prevent, diagnose, and treat disorders involving one or more of bone uptake, maintenance, and deposition, formation, maintenance, and repair of cartilage and skin, formation and maintenance of extracellular matrices, movement of cells through extracellular matrices, coagulation and dissolution of blood components, and deposition of materials in and on arterial walls.

TANGO 331 polypeptides, nucleic acids, and modulators thereof modulate growth, proliferation, survival, differentiation, and activity of human fetal, lung, spleen, and thymus cells and tissues. As described herein, TANGO 331 is involved in physiological activities such as maintenance of epithelia, carcinogenesis, modulation and storage of protein factors and metals, lactation, and infant nutrition. TANGO 331 also modulates cellular binding and uptake of cytokines, growth factors, and metal ions.

TANGO 332 polypeptides, nucleic acids, and modulators thereof modulate growth, proliferation, survival, differentiation, and activity of human brain and other tissues. As described herein, TANGO 332 is involved in modulating establishment and maintenance of neural connections, cell-to-cell adhesion, tissue and extracellular matrix invasivity, and the like.

TANGO 202 exhibits the ability to affect growth, proliferation, survival, differentiation, and activity of human hematopoietic cells (e.g., bone marrow stromal cells) and fetal cells. TANGO 202 modulates cellular binding to one or more mediators, modulates proteolytic activity in vivo, modulates developmental processes, and modulates cell growth, proliferation, survival, differentiation, and activity.

TANGO 234 exhibits the ability to affect growth, proliferation, survival, differentiation, and activity of human lung, hematopoietic, and fetal cells and of (e.g., bacterial or fungal)

cells and viruses which infect humans. TANGO 234 modulates growth, proliferation, survival, differentiation, and activity of gamma delta T cells, for example. Furthermore, TANGO 234 modulates cholesterol deposition on human arterial walls, and is involved in uptake and metabolism of low density lipoprotein and regulation of serum cholesterol levels.

TANGO 265 modulates growth and regeneration of neuronal and epithelial tissues, and guides neuronal axon development. TANGO 265 is a transmembrane protein which mediates cellular interaction with cells, molecules and structures (e.g., extracellular matrix) in the extracellular environment. TANGO 265 is involved in growth, organization, and adhesion of tissues and the cells which constitute those tissues. Furthermore, TANGO 265 modulates growth, proliferation, survival, differentiation, and activity of neuronal cells and immune system cells.

TANGO 286 protein is involved in lipid-binding physiological processes such as lipid transport, metabolism, serum lipid particle regulation, host anti-microbial defensive mechanisms, and the like.

TANGO 294 protein is involved in facilitating absorption and metabolism of fat. Disorders which can be modulated by TANGO 294 proteins, nucleic acids, and compounds that interact with them include, for example, inadequate expression of gastric/pancreatic lipase, cystic fibrosis, exocrine pancreatic insufficiency, medical treatments which alter fat absorption, and obesity.

INTERCEPT 296 protein is involved in physiological processes related to disorders of the human lung and esophagus. Disorders which can be modulated by INTERCEPT 296 proteins, nucleic acids, and compounds that interact with them include, for example, various cancers, bronchitis, cystic fibrosis, respiratory infections (e.g., influenza, bronchiolitis, pneumonia, and tuberculosis), asthma, emphysema, chronic bronchitis, bronchiectasis, pulmonary edema, pleural effusion, pulmonary embolus, adult and infant respiratory distress syndromes, heartburn, and gastric esophageal reflux disease.

In one embodiment, a polypeptide of the invention has an amino acid sequence sufficiently identical to a polypeptide of the invention or to an identified domain thereof. As used herein, the term "sufficiently identical" refers to a first amino acid or nucleotide sequence which contains a sufficient or minimum number of identical or equivalent (e.g., with a similar side chain) amino acid residues or nucleotides to a second amino acid or nucleotide sequence such that the first and second amino acid or nucleotide sequences have a common domain and/or common functional activity. For example, amino acid or nucleotide sequences which contain a common domain having about 65% identity, preferably 75% identity, more preferably 85%, 95%, or 98% identity are defined herein as sufficiently identical.

In one embodiment, the isolated polypeptide of the invention lacks both a transmembrane and a cytoplasmic domain. In another embodiment, the polypeptide lacks both a transmembrane domain and a cytoplasmic domain and is soluble under physiological conditions.

The polypeptides of the present invention, or biologically active portions thereof, can be operably linked with a heterologous amino acid sequence to form fusion proteins. The invention further features antibody substances that specifically bind a polypeptide of the invention, such as monoclonal or polyclonal antibodies, antibody fragments, and single-chain antibodies. In addition, the polypeptides of the invention or biologically active portions thereof can be incorporated into pharmaceutical compositions, which optionally include pharmaceutically acceptable carriers. These antibody substances can be made, for example, by providing the polypeptide of the invention to an immunocompetent vertebrate and thereafter harvesting blood or serum from the vertebrate.

In another aspect, the present invention provides methods for detecting the presence of the activity or expression of a polypeptide of the invention in a biological sample by contacting the biological sample with an agent capable of detecting an indicator of activity such that the presence of activity is detected in the biological sample.

In another aspect, the invention provides methods for modulating activity of a polypeptide of the invention comprising contacting a cell with an agent that modulates (inhibits or enhances) the activity or expression of a polypeptide of the invention such that activity or expression in the cell is modulated. In one embodiment, the agent is an antibody that specifically binds with a polypeptide of the invention.

In another embodiment, the agent modulates expression of a polypeptide of the invention by modulating transcription, splicing, or translation of an mRNA encoding a polypeptide of the invention. In yet another embodiment, the agent is a nucleic acid molecule having a nucleotide sequence that is antisense with respect to the coding strand of an mRNA encoding a polypeptide of the invention.

The present invention also provides methods of treating a subject having a disorder characterized by aberrant activity of a polypeptide of the invention or aberrant expression of a nucleic acid of the invention by administering an agent which is a modulator of the activity of a polypeptide of the invention or a modulator of the expression of a nucleic acid of the invention to the subject. In one embodiment, the modulator is a protein of the invention. In another embodiment, the modulator is a nucleic acid of the invention. In other embodiments, the modulator is a peptide, peptidomimetic, or other small molecule. In yet another embodiment, the modulator is an antibody.

The present invention also provides diagnostic assays for identifying the presence or absence of a genetic lesion or mutation characterized by at least one of: (i) aberrant modification or mutation of a gene encoding a polypeptide of the invention, (ii) mis-regulation of a gene encoding a polypeptide of the invention, and (iii) aberrant post-translational modification of a polypeptide of the invention wherein a wild-type form of the gene encodes a polypeptide having the activity of the polypeptide of the invention.

In another aspect, the invention provides a method for identifying a compound that binds with or modulates the activity of a polypeptide of the invention. In general, such methods entail measuring a biological activity of the polypeptide in the presence and absence of a test compound and identifying those compounds which bind with or alter the activity of the polypeptide.

The invention also features methods for identifying a compound which modulates the expression of a polypeptide or nucleic acid of the invention by measuring the expression of the polypeptide or nucleic acid in the presence and absence of the compound.

Other features and advantages of the invention will be apparent from the following detailed description and claims.

BRIEF DESCRIPTION OF THE DRAWINGS

FIG. 2A-2H is an alignment of a portion of the TANGO 416 cDNA sequence ("T416"; residues 1651-4000 of SEQ ID NO: 1) with a human testis cDNA clone having GenBank accession number AL137471 ("AL137471"; SEQ ID NO: 40). This alignment indicates that the two nucleotide sequences are about 98.6% identical over the overlapping region. The alignment was made using the ALIGN software (BLOSUM62 scoring matrix, gap opening penalty 12, gap extension penalty 4, frameshift gap penalty 5). In the alignments in this disclosure, similar residues are indicated by ".", and identical residues are indicated by ":" or "i".

FIG. 3A-3O is an alignment of a portion of the TANGO 416 ORF nucleotide sequence ("T416"; residues 1-3405 of SEQ ID NO: 2) with the ORF nucleotide sequence ("m-PC"; SEQ ID NO: 41) of murine protocadherin (sometimes designated vascular endothelial cadherin-2 or mVE-cad-2). This alignment indicates that the two nucleotide sequences are about 55.4% identical over the overlapping region. The alignment was made using the ALIGN-software (BLOSUM62 scoring matrix, gap opening penalty 12, gap extension penalty 4, frameshift gap penalty 5).

FIG. 4A-4E is an alignment of a portion of the TANGO 416 protein amino acid sequence ("T416"; residues 1-1135 of SEQ ID NO: 3) with the amino acid sequence ("m-PC"; SEQ ID NO: 42) of murine protocadherin. This alignment indicates that the two amino acid sequences are about 32.8% identical over the overlapping region. The alignment was made using the ALIGN software (BLOSUM62 scoring matrix, gap opening penalty 12, gap extension penalty 4).

FIGS. 6A through 6D depict a local alignment of the nucleic acid of human TANGO 457 shown in SEQ ID NO: 51 and a portion of the nucleotide sequence of human chromosome 11p4.3 PAC clone pDJ239b22, from nucleic acids 121077 to 122478 (SEQ ID NO: 61; accession number AC003969). In the alignment, the TANGO 457 sequence is the top strand, and the 11p14.3 PAC clone pDJ239b22 sequences is on the bottom. The alignment shows that there is 100% nucleotide sequence identity between the TANGO 457 sequence of SEQ ID NO: 51 and human chromosome 11p14.3 PAC clone pDJ239b22, from nucleotides 908 to 2305 of TANGO 457. This alignment was performed using the ALIGN alignment program with a PAM120 scoring matrix, a gap length penalty of 12, and a gap penalty of 4.

FIG. 8 is an alignment, made using the Wisconsin™ BestFit software (Smith and Waterman, (1981) Adv. Appl. Math. 2:482-489; BLOSUM62 scoring matrix, gap opening penalty 10/gap extension penalty 10) of the amino acid sequences of murine myeloid DNAX accessory protein associated lectin-1 ("M"; MDL-1; SEQ ID NO: 88), murine INTERCEPT 289 ("R"; SEQ ID NO: 163), human MDL-1 ("H"; SEQ ID NO: 86), form 1a of INTERCEPT 289 ("A"; SEQ ID NO: 83), form 1b of INTERCEPT 289 ("B"; SEQ ID NO: 93), form 2a of INTERCEPT 289 ("C"; SEQ ID NO: 98), form 2b of INTERCEPT 289 ("D"; SEQ ID NO: 103), form 3a of INTERCEPT 289 ("E"; SEQ ID NO: 108), and form 3b of INTERCEPT 289 ("F"; SEQ ID NO: 113).

FIGS. 9A-9N is an alignment (made using the Wisconsin™ BestFit software; Smith and Waterman, (1981) Adv. Appl. Math. 2:482-489; gap opening penalty 10/gap extension penalty 10), of the nucleotide sequences of cDNA molecules encoding form 1a of INTERCEPT 289 ("A"; SEQ ID NO: 81), form 1b of INTERCEPT 289 ("B"; SEQ ID NO: 91), form 2a of INTERCEPT 289 ("C"; SEQ ID NO: 96), form 2b of INTERCEPT 289 ("D"; SEQ ID NO: 101), form 3a of INTERCEPT 289 ("E"; SEQ ID NO: 106), and form 3b of INTERCEPT 289 ("F"; SEQ ID NO: 111).

FIGS. 11A and 11B are a manual alignment of the nucleotide sequences of murine INTERCEPT 289 ORF ("M1289"; SEQ ID NO: 162) and the ORF of form 1a of human INTERCEPT 289 ("HI289"; SEQ ID NO: 82).

An alignment (made using the ALIGN software; pam120.mat scoring matrix, gap opening penalty=12, gap extension penalty=4) of the nucleotide sequences of a cDNA clone ("DKFZ"; SEQ ID NO: 134; GenBank accession no. AL049977) obtained from human fetal brain tissue and INTERCEPT 309 cDNA ("I309"; SEQ ID NO: 121) is shown in FIGS. 14a-14G.

An alignment (made using the ALIGN software; pam120.mat scoring matrix, gap opening penalty=12, gap extension penalty=4) of the nucleotide sequences of the cDNA encoding human INTERCEPT 309 ("I309"; SEQ ID NO: 121) and a portion of a cDNA encoding murine claudin-8 protein ("CLAUD8"; SEQ ID NO: 132) is shown in FIGS. 15A-15G.

An alignment (made using the ALIGN software; pam120.mat scoring matrix, gap opening penalty=12, gap extension penalty=4) of the amino acid sequences of human INTERCEPT 309 protein ("I309"; SEQ ID NO: 123) and murine claudin-8 protein ("CLAUD8"; SEQ ID NO: 133) is shown in FIG. 16.

A manual alignment of individual alignments (made using the Wisconsin™ BestFit software; Smith and Waterman (1981) Adv. Appl. Math. 2:482-489; blosum62 scoring matrix, gap opening penalty 10/gap extension penalty 10) of the amino acid sequences of human INTERCEPT 309 protein ("I309"; SEQ ID NO: 123) with each of human *Clostridium perfringens* enterotoxin receptor ("hCPE"; SEQ ID NO: 135), murine *C. perfringens* enterotoxin receptor ("mCPE"; SEQ ID NO: 136), and a protein encoded by a cDNA recovered from regressing rat ventral prostate tissue ("rRPV"; SEQ ID NO: 137) is shown in FIG. 17.

Figure 18:
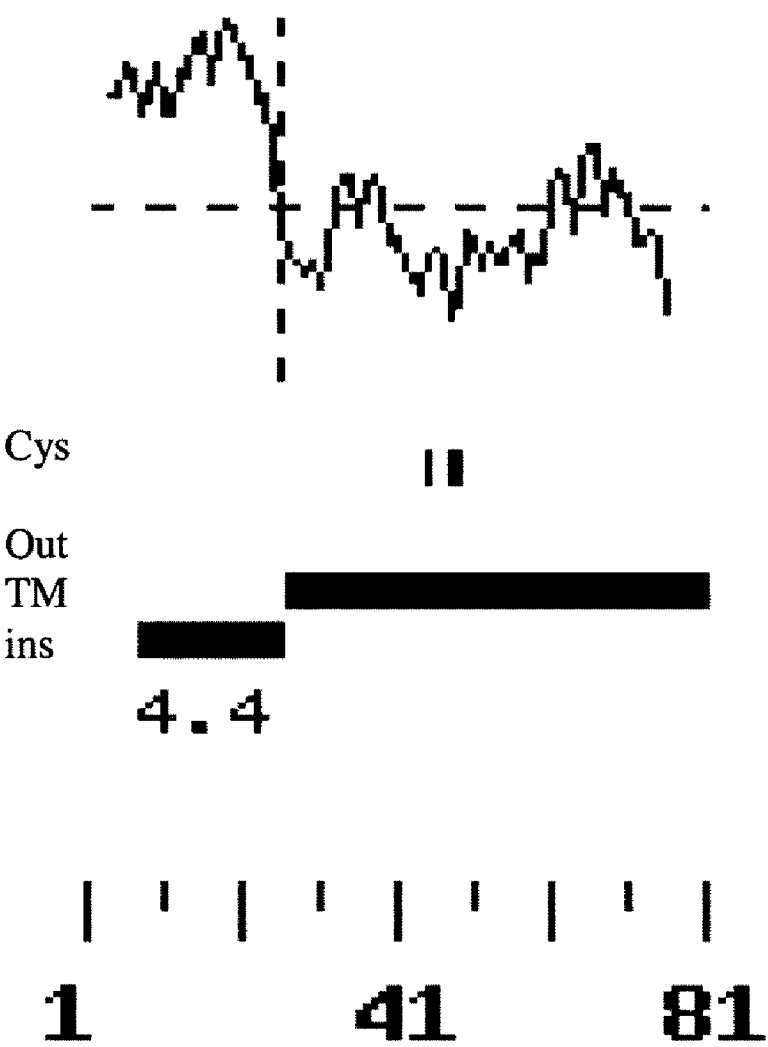

FIG. 18 is a hydrophobicity plot of human MANGO 419 protein.

Figure 19:
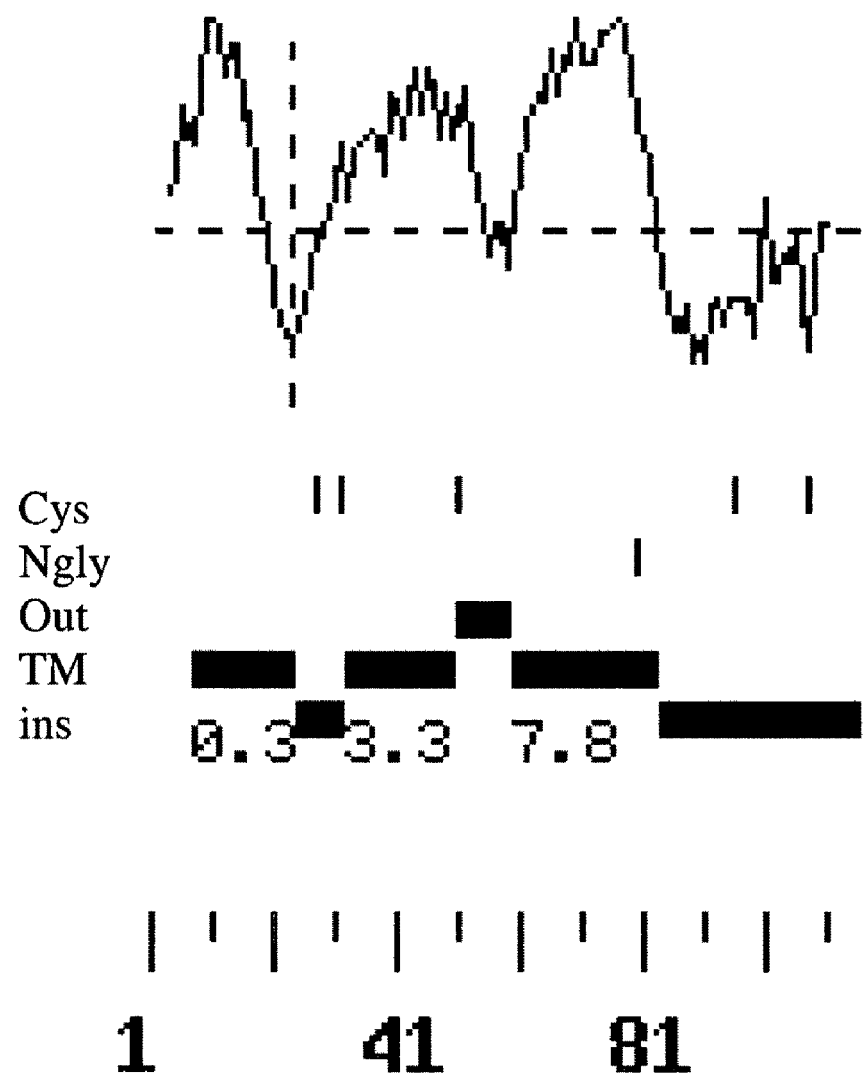

FIG. 19 is a hydrophobicity plot of human INTERCEPT 429 protein.

Figure 20:
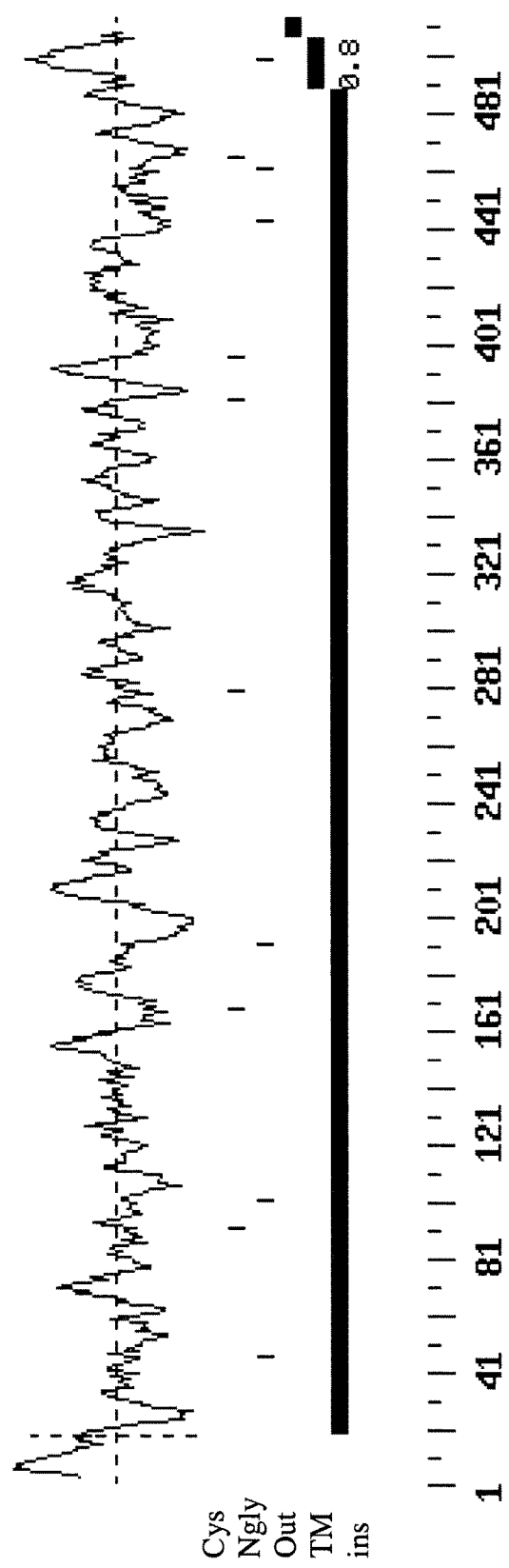

FIG. 20 is a hydrophobicity plot of human TANGO 210 protein (the conformation of the alternative form of TANGO 210 protein, wherein the carboxyl terminal portion comprises a transmembrane domain, is shown here).

Figure 21:
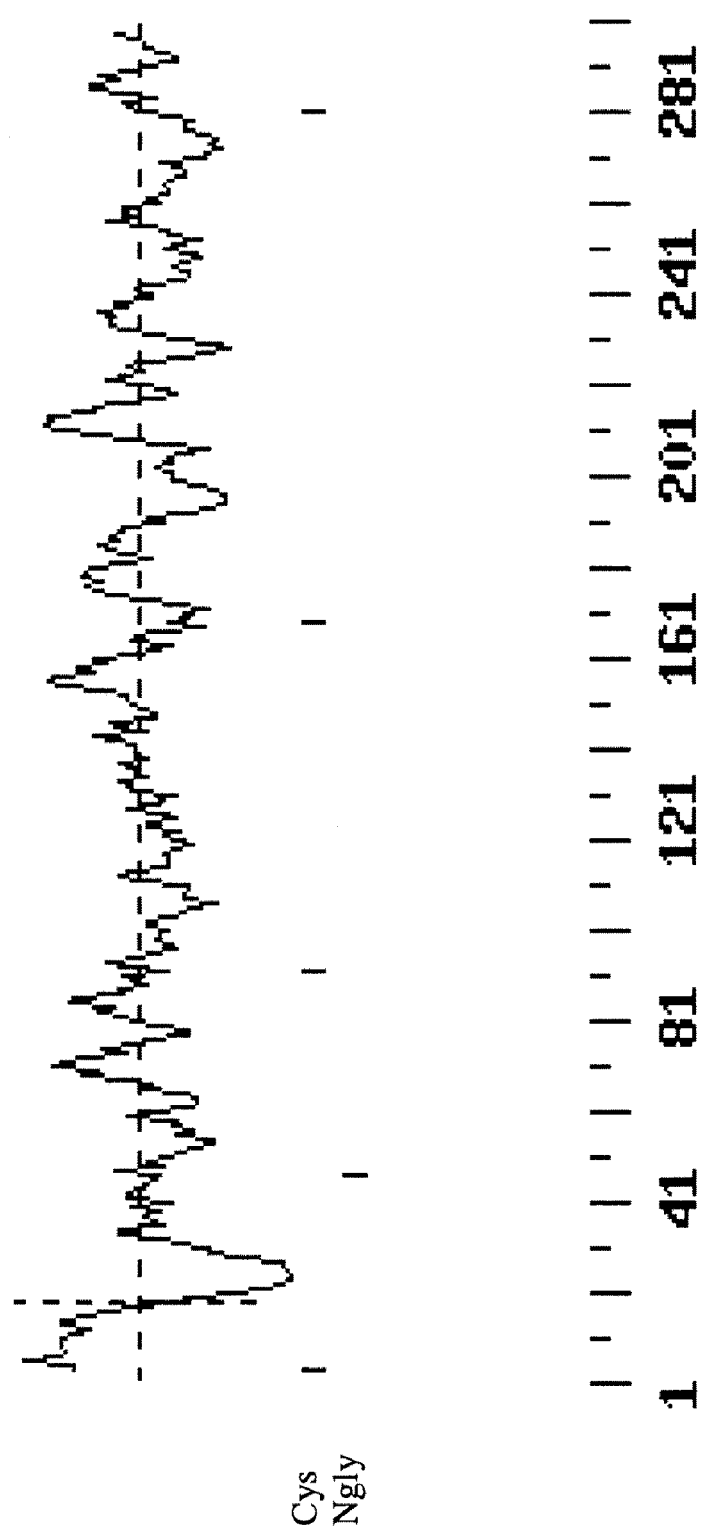

FIG. 21 is a hydrophobicity plot of murine TANGO 210 protein.

An alignment of the amino acid sequences of human TANGO 210 protein (SEQ ID NO: 173) and murine TANGO 210 protein (SEQ ID NO: 183) amino acid sequences is shown in FIGS. 22A-22B, wherein identical amino acid residues are indicated by ":" and similar amino acid residues are indicated by ".".

An alignment of the nucleotide sequences of the human (SEQ ID NO: 171) and murine (SEQ ID NO: 181) cDNAs encoding TANGO 210 protein is shown in FIGS. 23A-23I. FIGS. 24A-24B are an alignment of the amino acid sequences of human TANGO 210 protein ("210"; SEQ ID NO: 173) and human matrix metalloproteinase-8 (MMP-8; "MMP-8"; SEQ ID NO: 176).

An alignment of the nucleotide sequences of the open reading frame (ORF) encoding human TANGO 210 ("210"; SEQ ID NO: 172) and the ORF encoding human MMP-8 (SEQ ID NO: 177) is shown in FIGS. 24A-25F.

Figure 26:
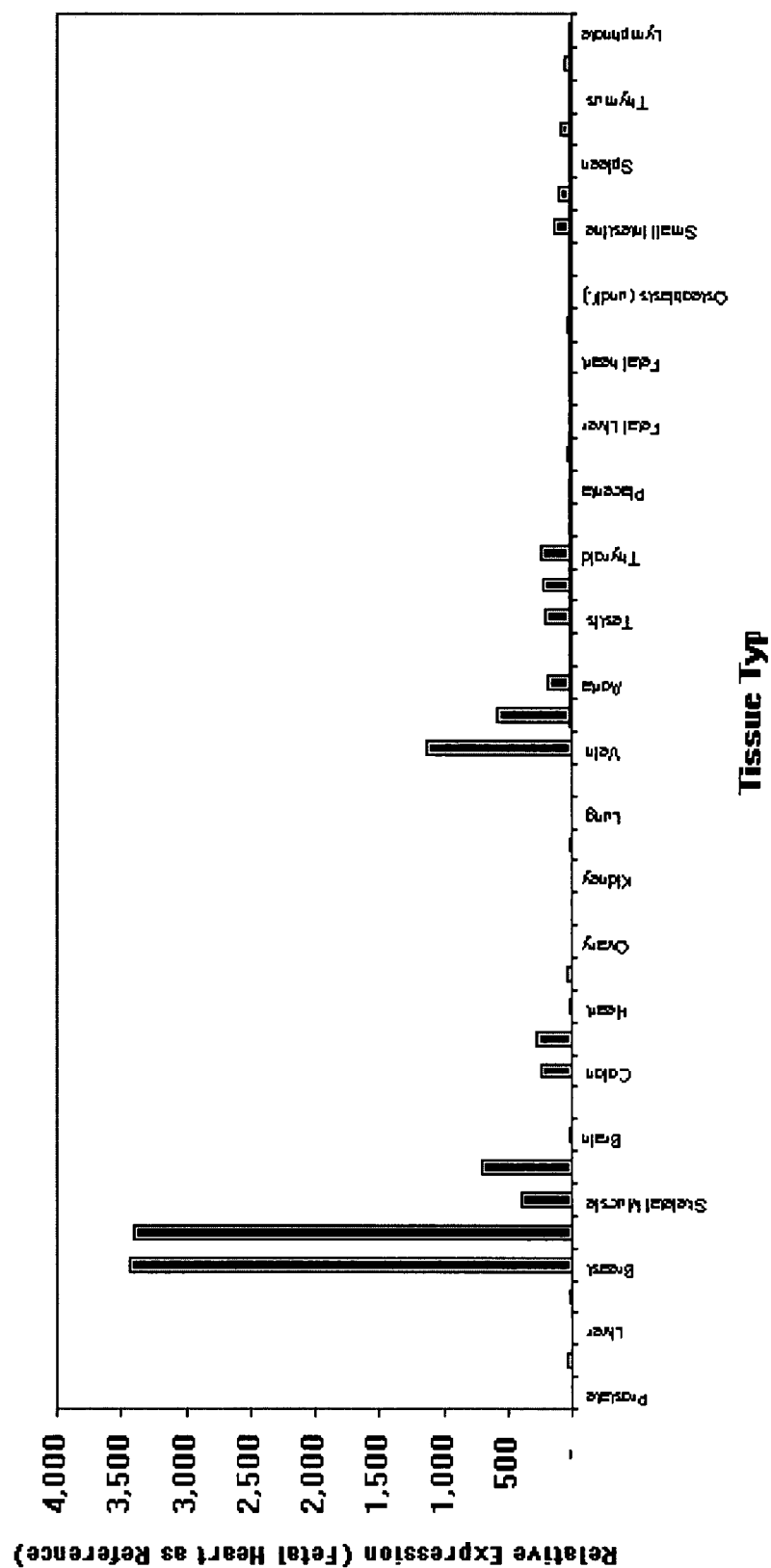

FIG. 26 is a graph which depicts expression of TANGO 210 mRNA in selected human tissue and cell types, relative to TANGO 210 expression in the human fetal heart tissue.

Figure 27:
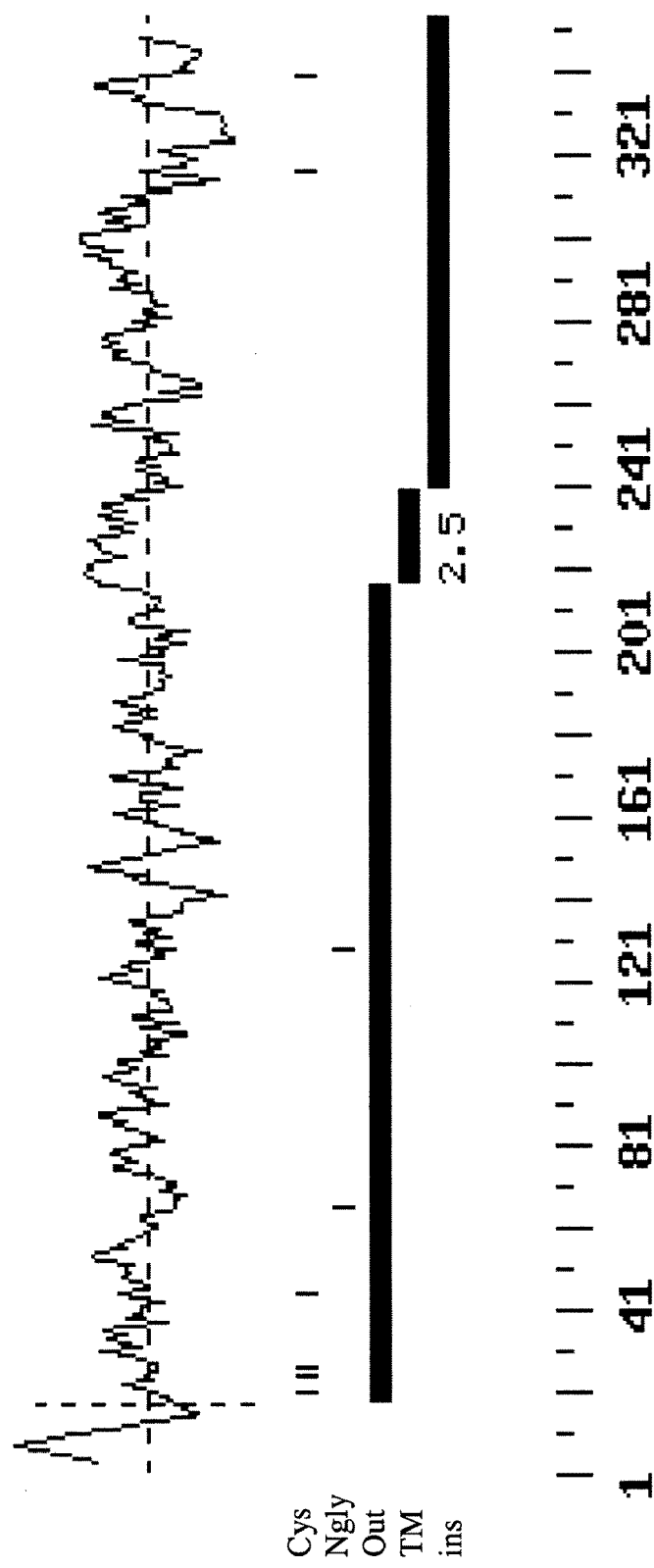

FIG. 27 is a hydrophobicity plot of human TANGO 366 protein.

Figure 28:
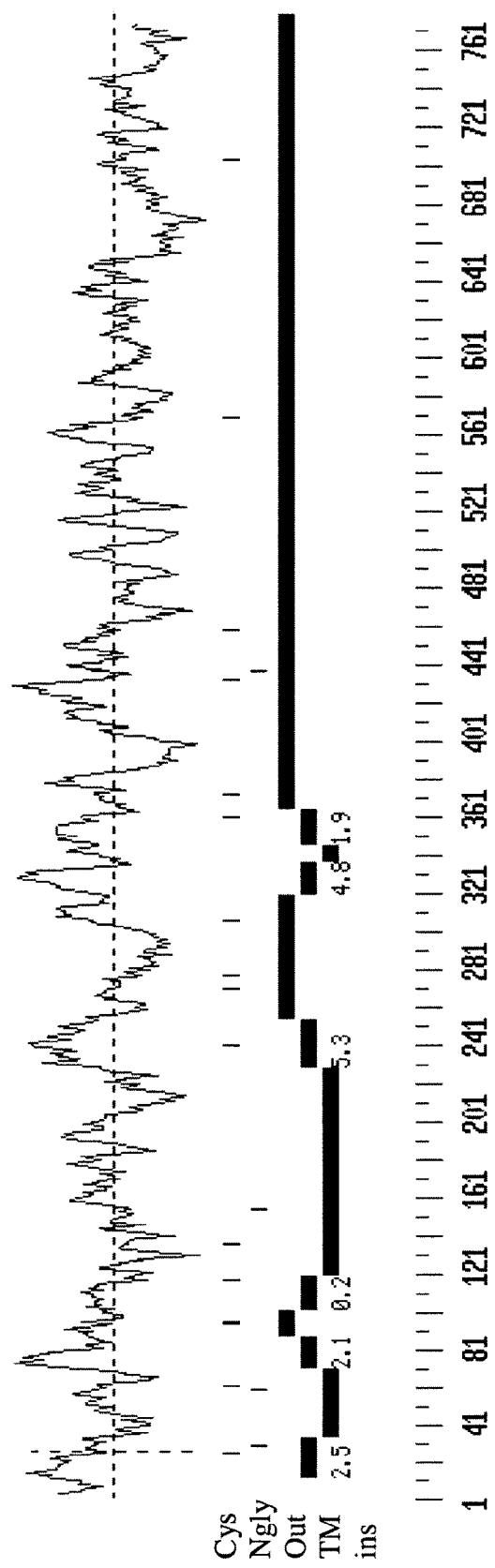

FIG. 28 is a hydrophobicity plot of human INTERCEPT 394 protein.

Figure 29:
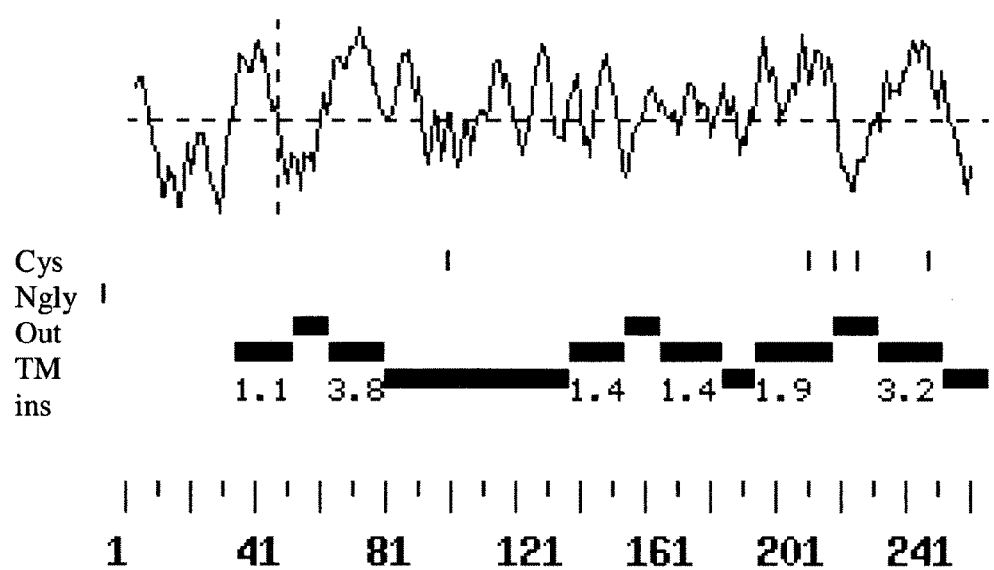

FIG. 29 is a hydrophobicity plot of human INTERCEPT 400 protein.

Figure 30:
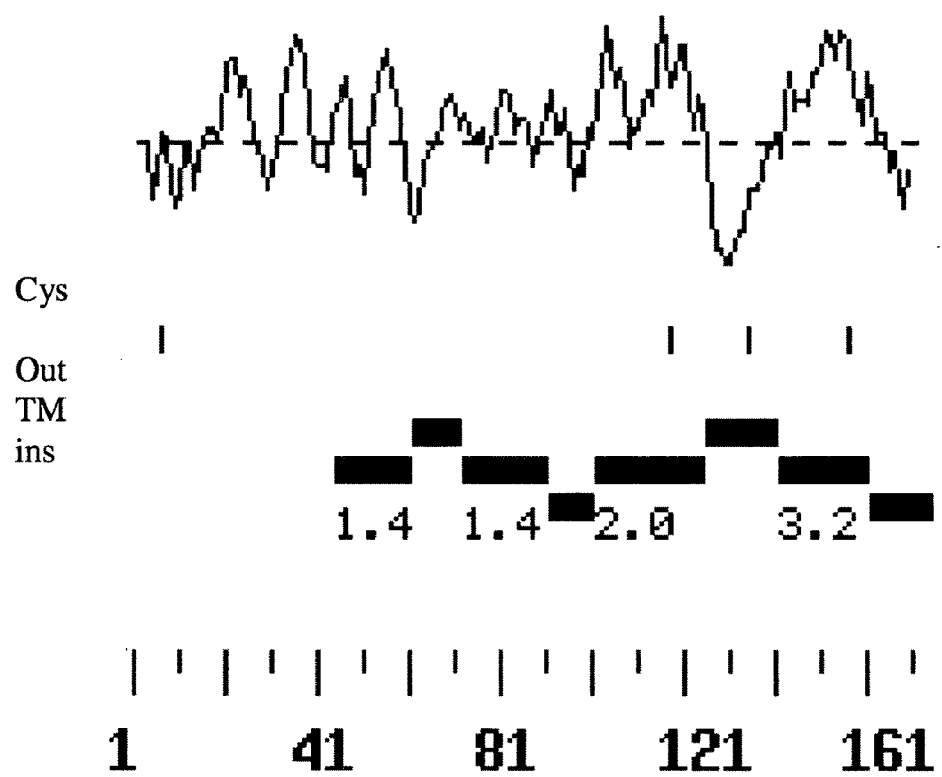

FIG. 30 is a hydrophobicity plot of murine INTERCEPT 400 protein.

An alignment of the amino acid sequences of human INTERCEPT 400 protein (SEQ ID NO: 223) and murine INTERCEPT 400 protein (SEQ ID NO: 243) amino acid sequences is shown in FIG. 31.

An alignment of the nucleotide sequences of the human (SEQ ID NO: 222) and murine (SEQ ID NO: 242) ORFs encoding INTERCEPT 400 protein is shown in FIGS. 32A-32C.

FIG. 33 is an alignment of the amino acid sequences of human INTERCEPT 400 protein ("1400"; SEQ ID NO: 223) and murine Cig30 protein ("CIG30"; SEQ ID NO: 239).

An alignment of the nucleotide sequences of the ORFs encoding human INTERCEPT 400 protein ("1400"; SEQ ID NO: 222) and the ORF encoding murine Cig30 ("CIG30"; SEQ ID NO: 238) is shown in FIGS. 34A-34C.

FIG. 35 is an alignment of the amino acid sequences of human (SEQ ID NO: 223), murine (SEQ ID NO: 243), and rat (SEQ ID NO: 253) INTERCEPT 400 proteins.

Figure 36:
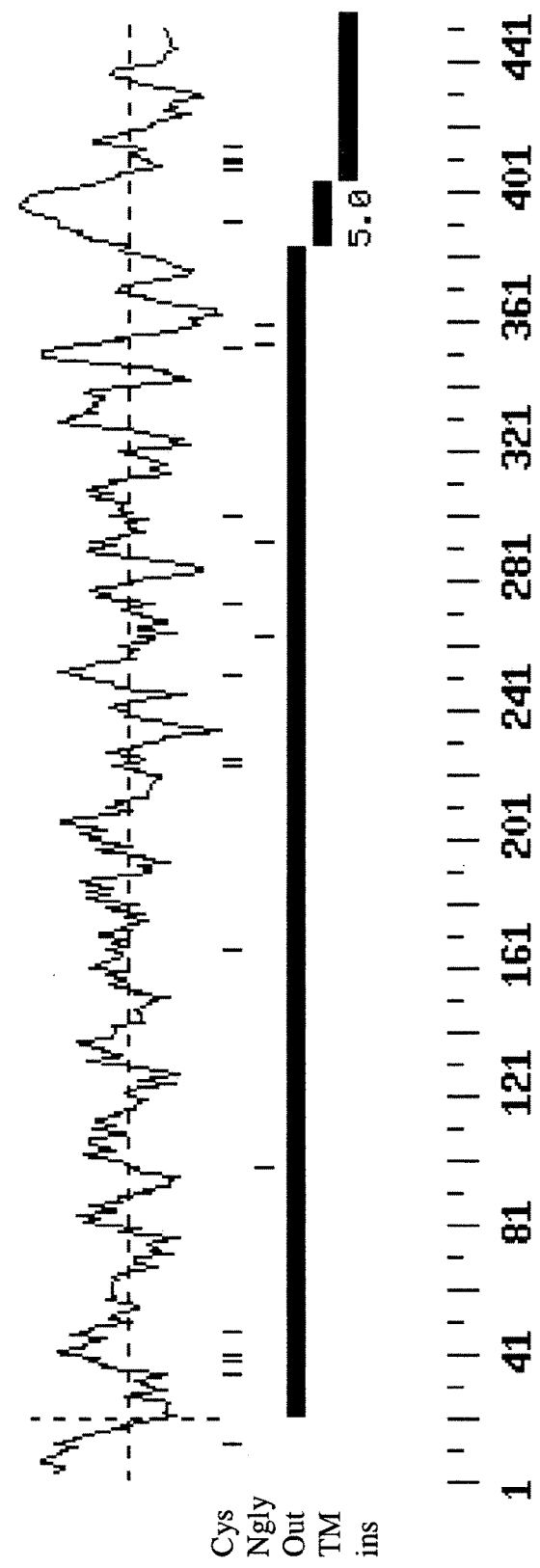

FIG. 36 is a hydrophobicity plot of human INTERCEPT 217 protein.

An alignment of the amino acid sequences of human INTERCEPT 217 protein ("H"; SEQ ID NO: 273) and porcine ribonuclease inhibitor protein ("P"; SwissProt Accession number P10775; SEQ ID NO: 334) is shown in FIGS. 37A-37B. These alignments were made using the ALIGN software {Myers and Miller (1989) CABIOS, ver. 2.0}; pam120.mat scoring matrix; gap opening penalty=12, gap extension penalty=4).

Figure 38:
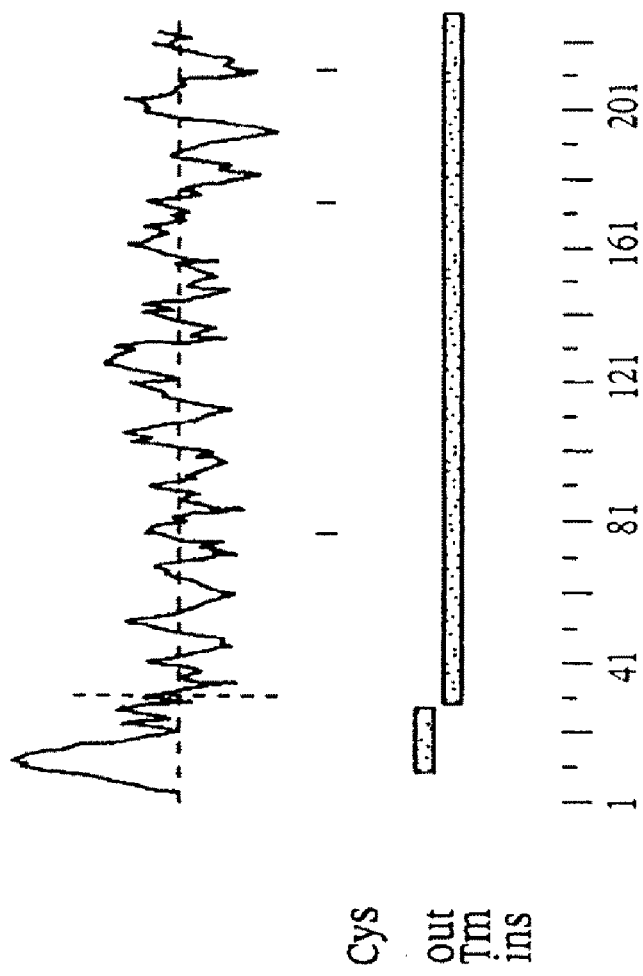

FIG. 38 is a hydrophobicity plot of murine INTERCEPT 217 protein.

An alignment of the amino acid sequences of human INTERCEPT 217 protein ("H"; SEQ ID NO: 273) and murine INTERCEPT 217 protein ("M"; SEQ ID NO: 363) is shown in FIG. 39. These alignments were made using the BESTFIT software (BLOSUM62 scoring matrix, gap opening penalty=12, frameshift gap penalty=5, gap extension penalty=4).

Figure 40:
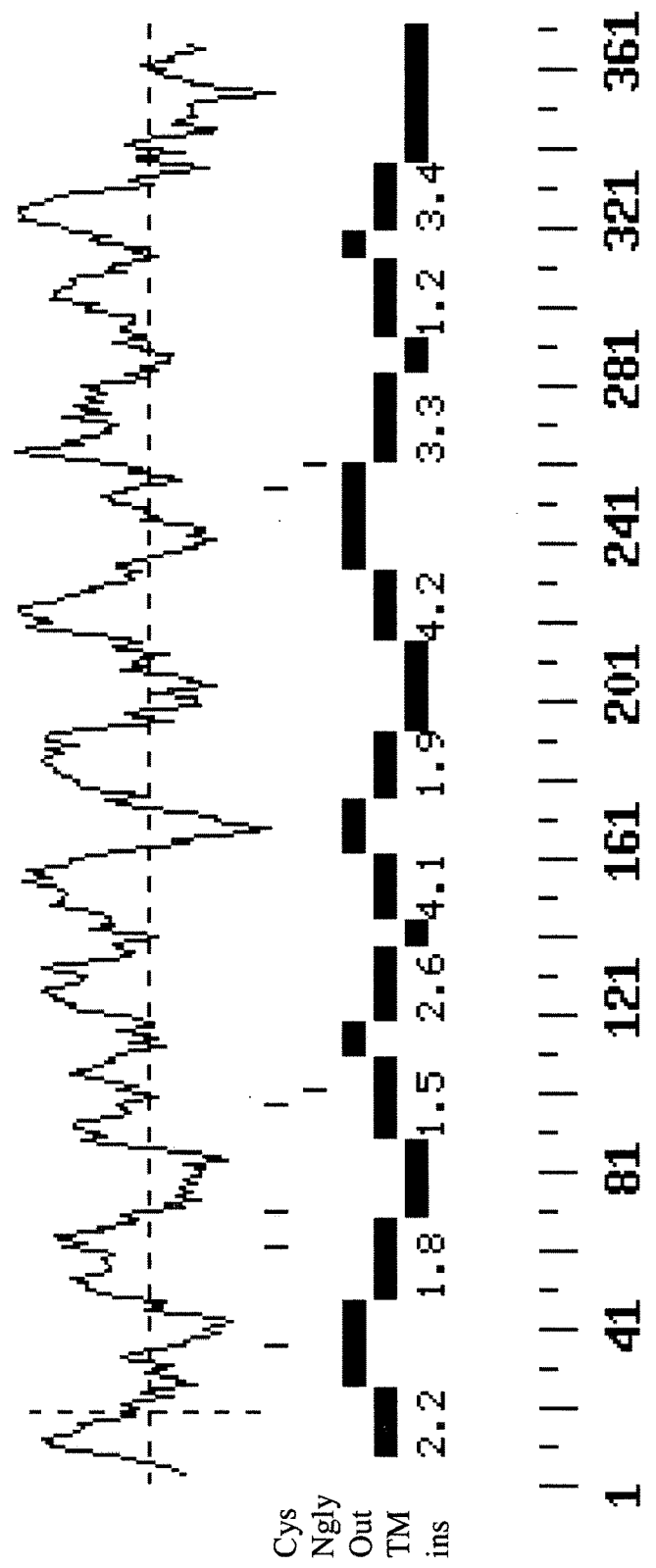

FIG. 40 is a hydrophobicity plot of human INTERCEPT 297 protein.

Figure 41:
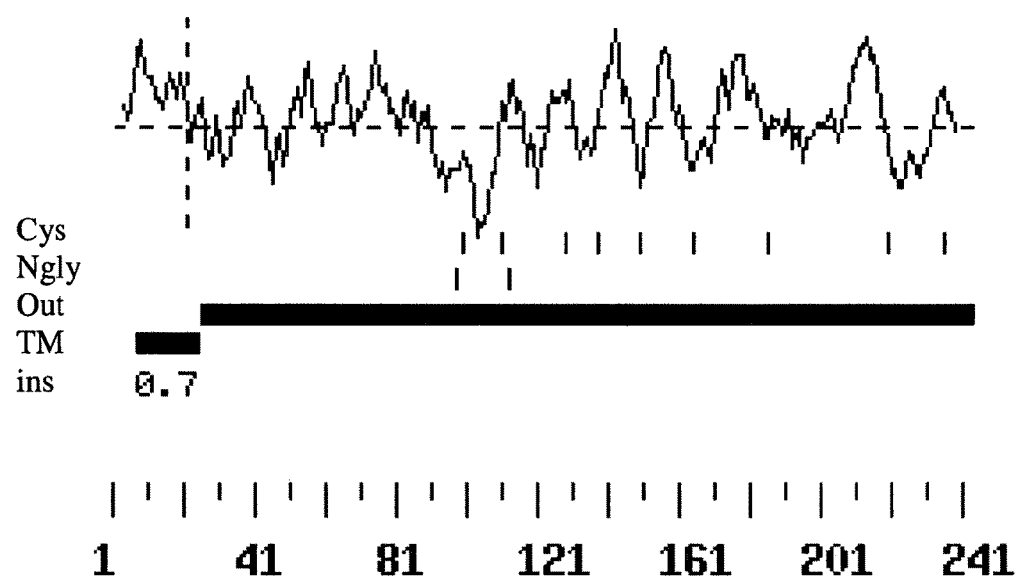

FIG. 41 is a hydrophobicity plot of TANGO 276 protein.

An alignment of the amino acid sequences of human TANGO 276 protein ("H"; —SEQ ID NO: 305) and murine protein M-Sema-F ("M"; SEQ ID NO: 335) is shown in FIGS. 42A-42C.

In FIGS. 43A-43J, an alignment of the nucleotide sequences of the cDNA encoding human TANGO 276 protein ("H"; SEQ ID NO: 303) and the nucleotide sequences of the cDNA encoding murine protein M-Sema-F ("M"; SEQ ID NO: 66) is shown. These alignments were made using the ALIGN software {Myers and Miller (1989) CABIOS, ver. 2.0}; pam120.mat scoring matrix; gap opening penalty=12, gap extension penalty=4).

Figure 44:
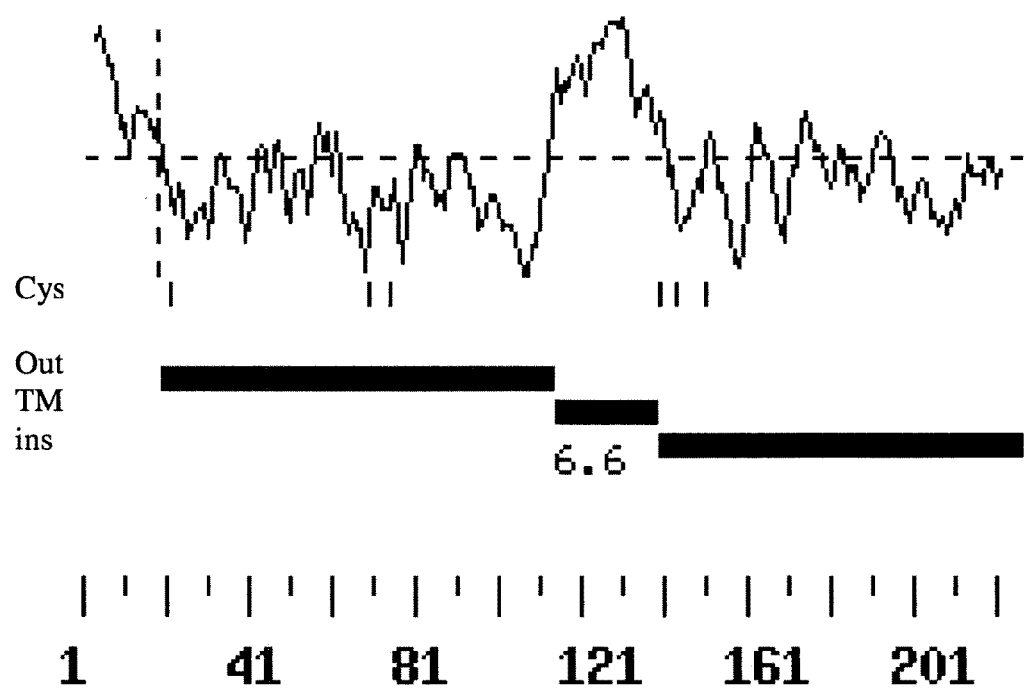

FIG. 44 is a hydrophobicity plot of human TANGO 292 protein.

FIGS. 45A-45C are an alignment of the nucleotide sequences of the ORF encoding human TANGO 292 protein ("H"; SEQ ID NO: 308) and the nucleotide sequence of the ORF encoding gerbil TANGO 292 protein ("G"; SEQ ID NO: 351), made using the ALIGN software {Myers and Miller (1989) CABIOS, ver. 2.0}; pam120.mat scoring matrix; gap opening penalty=12, gap extension penalty=4).

FIG. 46 is an alignment of the human (H) and gerbil (G) TANGO 292 amino acid sequences, made using the same software and parameters.

Figure 47:
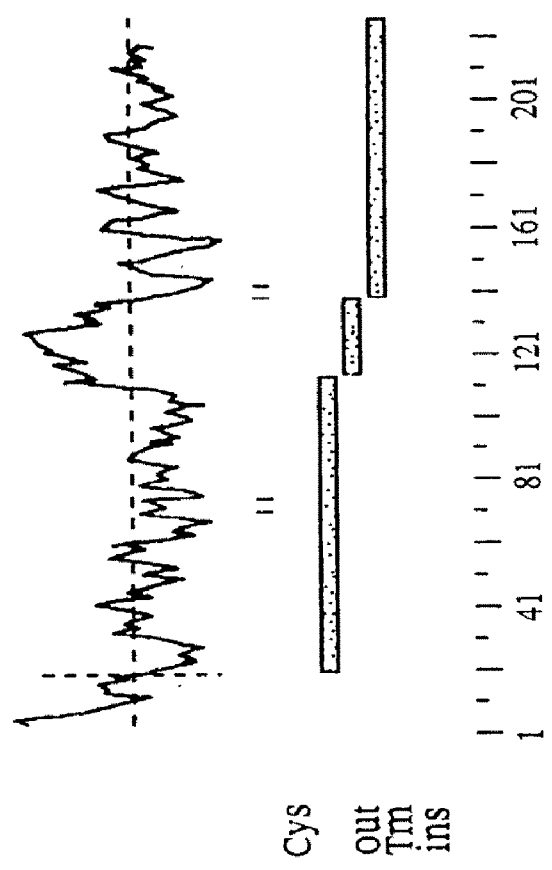

FIG. 47 is a hydrophobicity plot of gerbil TANGO 292 protein.

Figure 48:
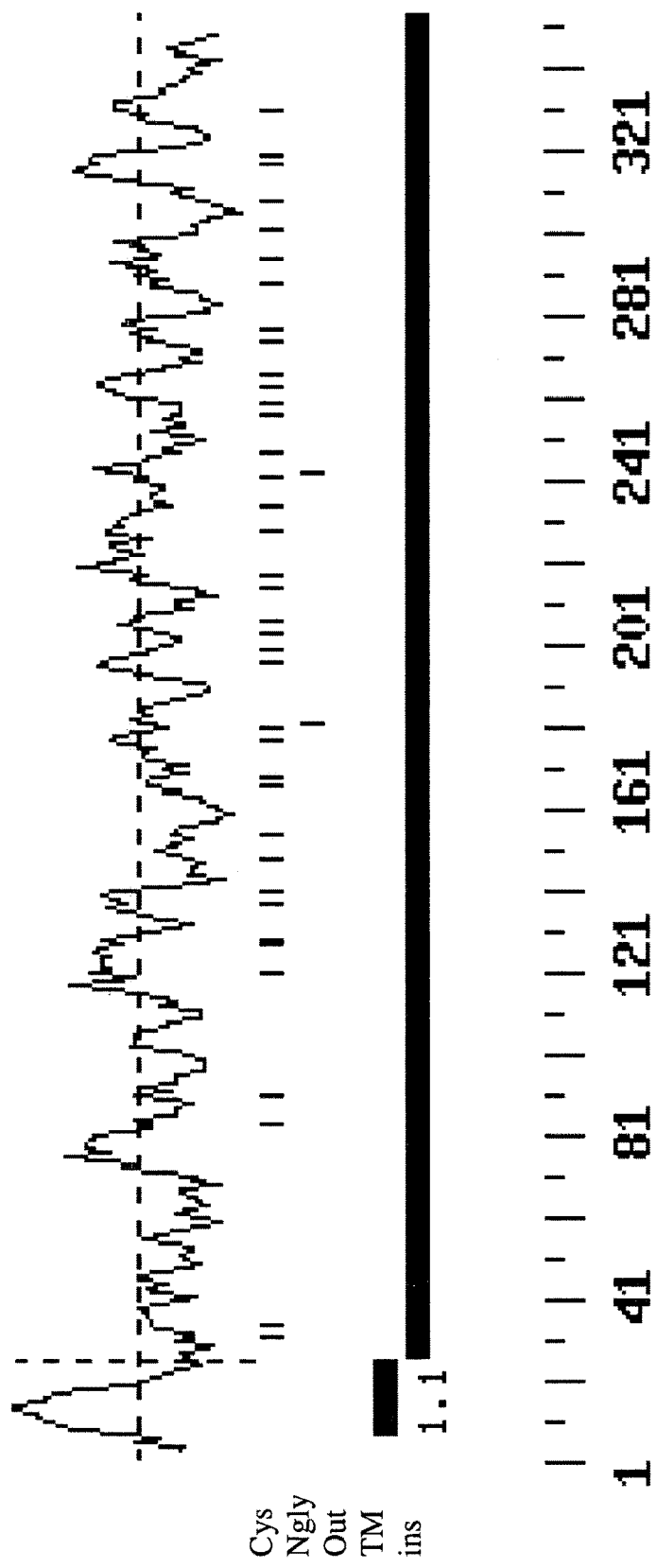

FIG. 48 is a hydrophobicity plot of TANGO 331 protein.

An alignment of the amino acid sequences of human TANGO 331 protein ("H"; SEQ ID NO: 326) and Chinese hamster protein HT ("C"; SEQ ID NO: 339; GenBank Accession No. U48852) is shown in FIG. 49.

In FIGS. 50A-50E, an alignment of the nucleotide sequences of the cDNA encoding human TANGO 331 protein ("H"; SEQ ID NO: 324) and the nucleotide sequence of the cDNA encoding Chinese hamster protein HT ("C"; SEQ ID NO: 340) is shown. These alignments were made using the ALIGN software {Myers and Miller (1989) CABIOS, ver. 2.0}; pam120.mat scoring matrix; gap opening penalty=12, gap extension penalty=4).

Figure 51:
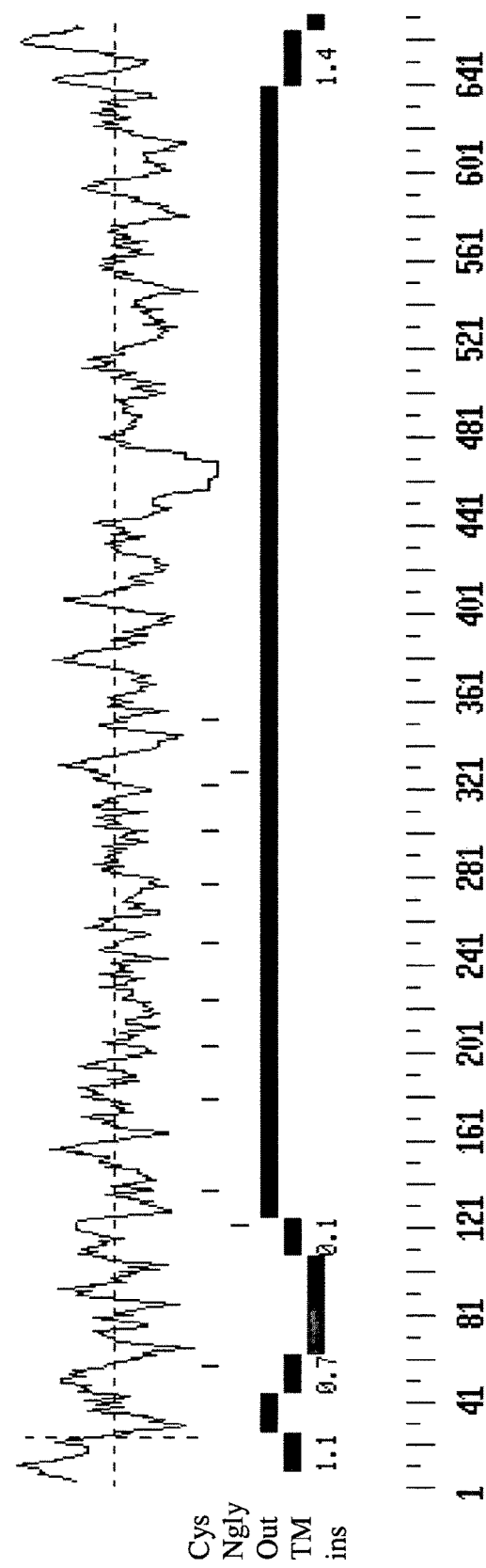

FIG. 51 is a hydrophobicity plot of TANGO 332 protein.

An alignment of the amino acid sequences of TANGO 332 protein ("332"; SEQ ID NO: 331) and BEF protein ("BEF"; SEQ ID NO: 341) is shown in FIGS. 52A-52B.

An alignment of the amino acid sequences of human TANGO 332 protein ("H"; SEQ ID NO: 331) and murine brevidin protein ("M"; SEQ ID NO: 342) is shown in FIGS. 53A-53C.

In FIGS. 54A-54J, an alignment of the nucleotide sequences of the cDNA encoding human TANGO 332 protein ("H"; SEQ ID NO: 330) and the nucleotide sequence of the cDNA encoding murine brevidin protein ("M"; SEQ ID NO: 343) is shown. These alignments were made using the ALIGN software {Myers and Miller (1989) CABIOS, ver. 2.0}; pam120.mat scoring matrix; gap opening penalty=12, gap extension penalty=4).

An alignment of the amino acid sequences of human ("Hum."; SEQ ID NO: 373) and murine ("Mur."; SEQ ID NO: 439) TANGO 202 protein is shown in FIGS. 55A-55B.

Figure 56A:
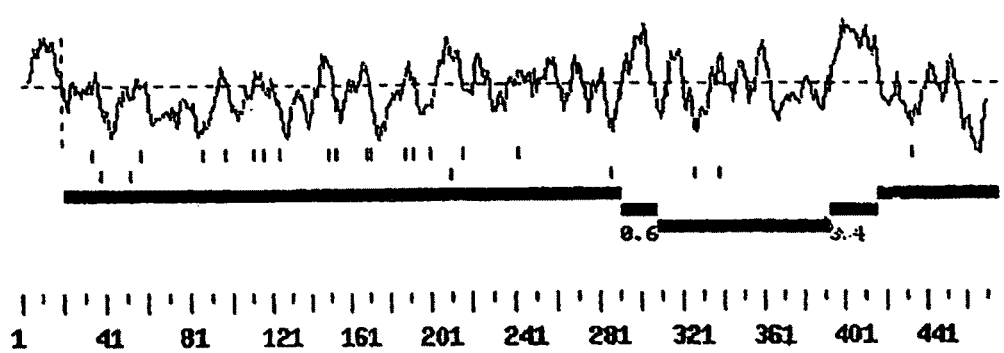

FIG. 56A is a hydrophobicity plot of human TANGO 202 protein.

Figure 56B:
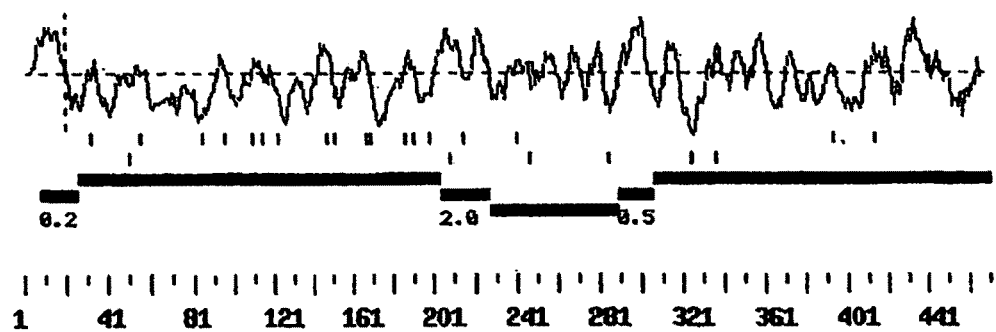

FIG. 56B is a hydrophobicity plot of murine TANGO 202 protein.

Figure 57:
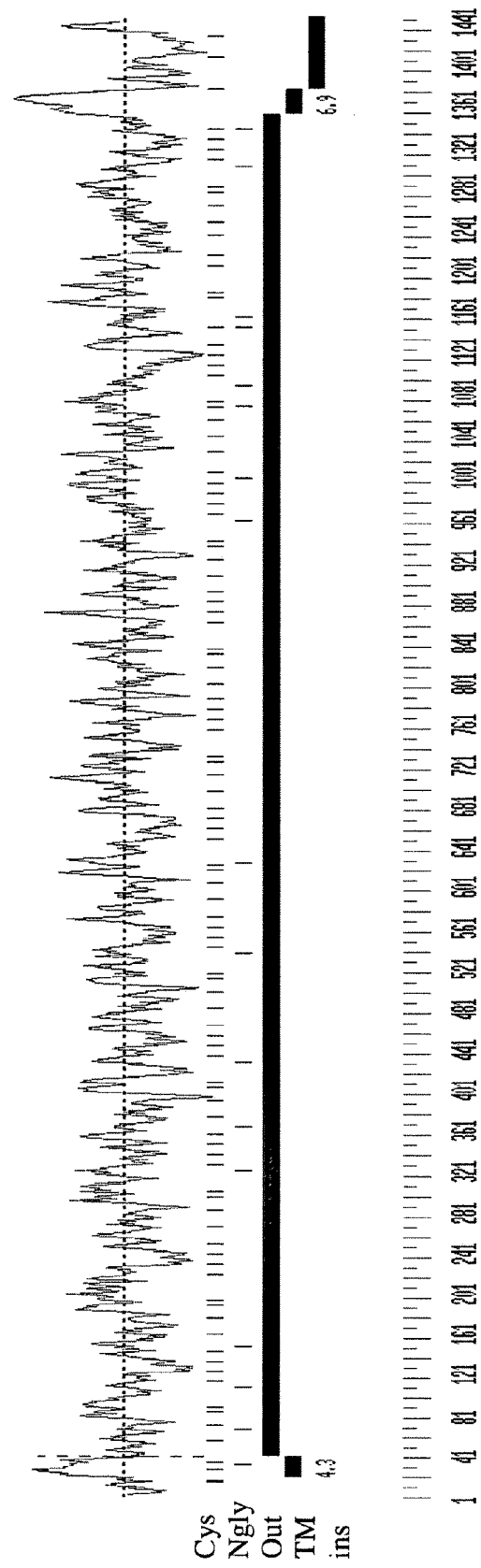

FIG. 57 is a hydrophobicity plot of human TANGO 234 protein.

An alignment of the amino acid sequences of human TANGO 234 ("Hum"; SEQ ID NO: 381) and bovine WC1 ("WC1"; SEQ ID NO: 448) proteins is shown in FIGS. 58A-58F An alignment of the nucleotide sequences of an ORF encoding human TANGO 234 ("Hum"; SEQ ID NO: 380) and an ORF encoding bovine WC1 ("WC1"; SEQ ID NO: 449) proteins is shown in FIGS. 26Q-1 to 59A-59Q.

An alignment of the amino acid sequences of human TANGO 265 protein ("Hum."; SEQ ID NO: 389) and murine semaphorin B protein ("Mur."; SEQ ID NO: 440; GenBank Accession No. X85991) is shown in FIGS. 60A-60C. In FIGS. 61A-61L, an alignment of the nucleotide sequences of the cDNA encoding human TANGO 265 protein ("Hum."; SEQ ID NO: 387) and the nucleotide sequences of the cDNA encoding murine semaphorin B protein ("Mur."; SEQ ID NO: 441; GenBank Accession No. X85991) is shown.

Figure 62:
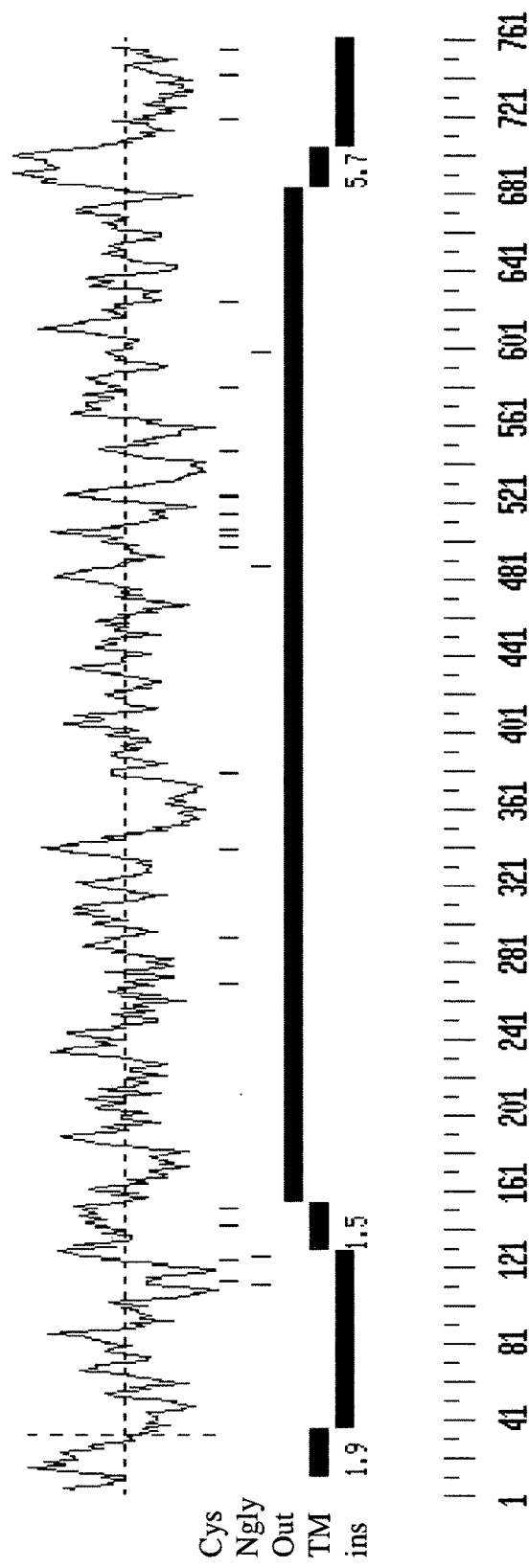

FIG. 62 is a hydrophobicity plot of TANGO 265 protein.

Figure 63:
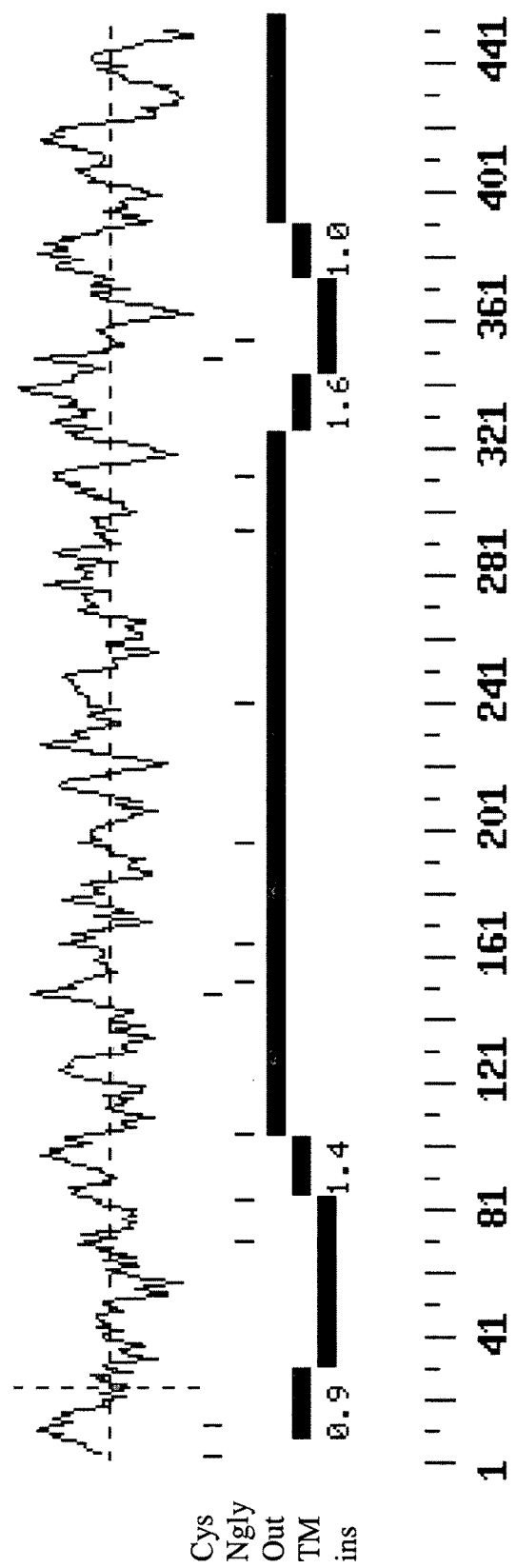

FIG. 63 is a hydrophobicity plot of TANGO 286 protein.

An alignment of the amino acid sequences of human TANGO 286 ("286"; SEQ ID NO: 405) and BPI protein ("BPI". SEQ ID NO: 408) protein is shown in FIGS. 64A-64B.

An alignment of the amino acid sequences of human TANGO 286 ("286"; SEQ ID NO: 405) and RENP protein ("RENP"; SEQ ID NO: 409) is shown in FIGS. 65A-65B.

An alignment of the amino acid sequences of human TANGO 294 protein ("294"; SEQ ID NO: 417) and a known human lipase protein ("HLP"; SEQ ID NO: 445; GenBank Accession No. NP_004181) is shown in FIGS. 66A-66B.

Figure 67:
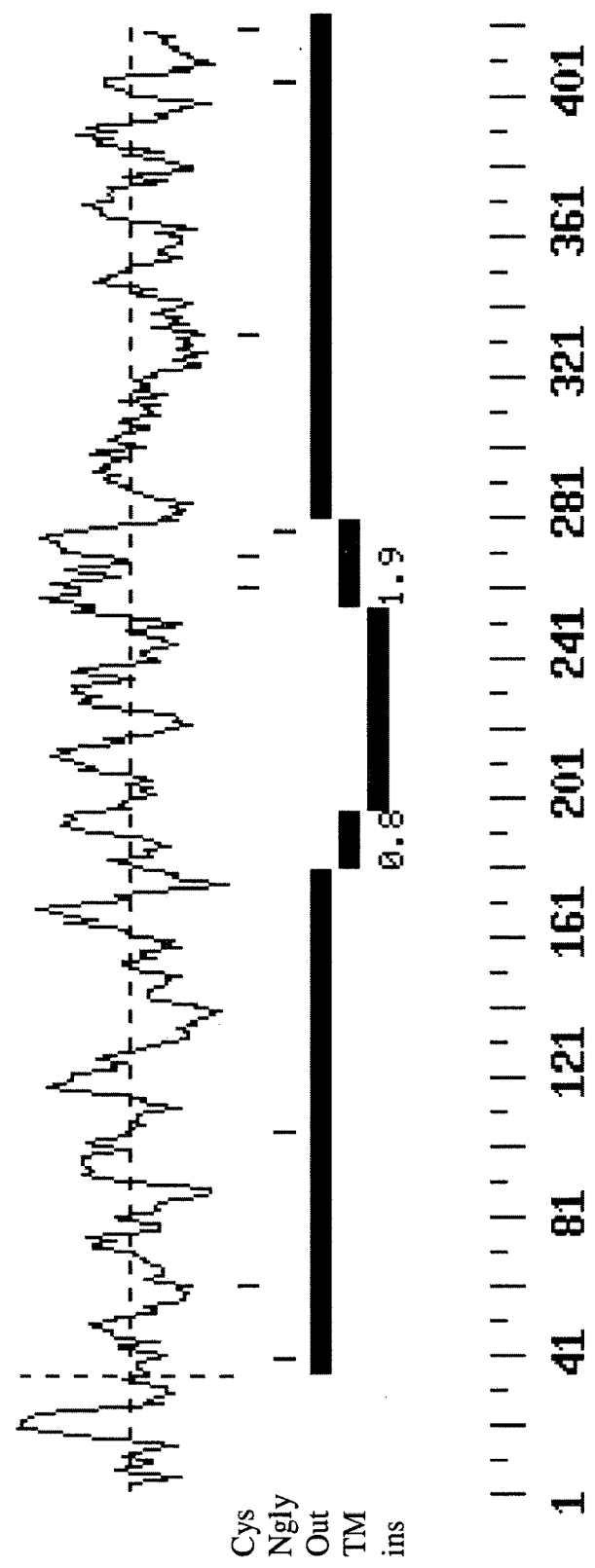

FIG. 67 is a hydrophobicity plot of TANGO 294 protein.

An alignment of the amino acid sequences of human TANGO 294 protein ("294"; SEQ ID NO: 417) and a known human lysosomal acid lipase protein ("LAL"; SEQ ID NO: 411) is shown in FIGS. 68A-68B.

Figure 69:
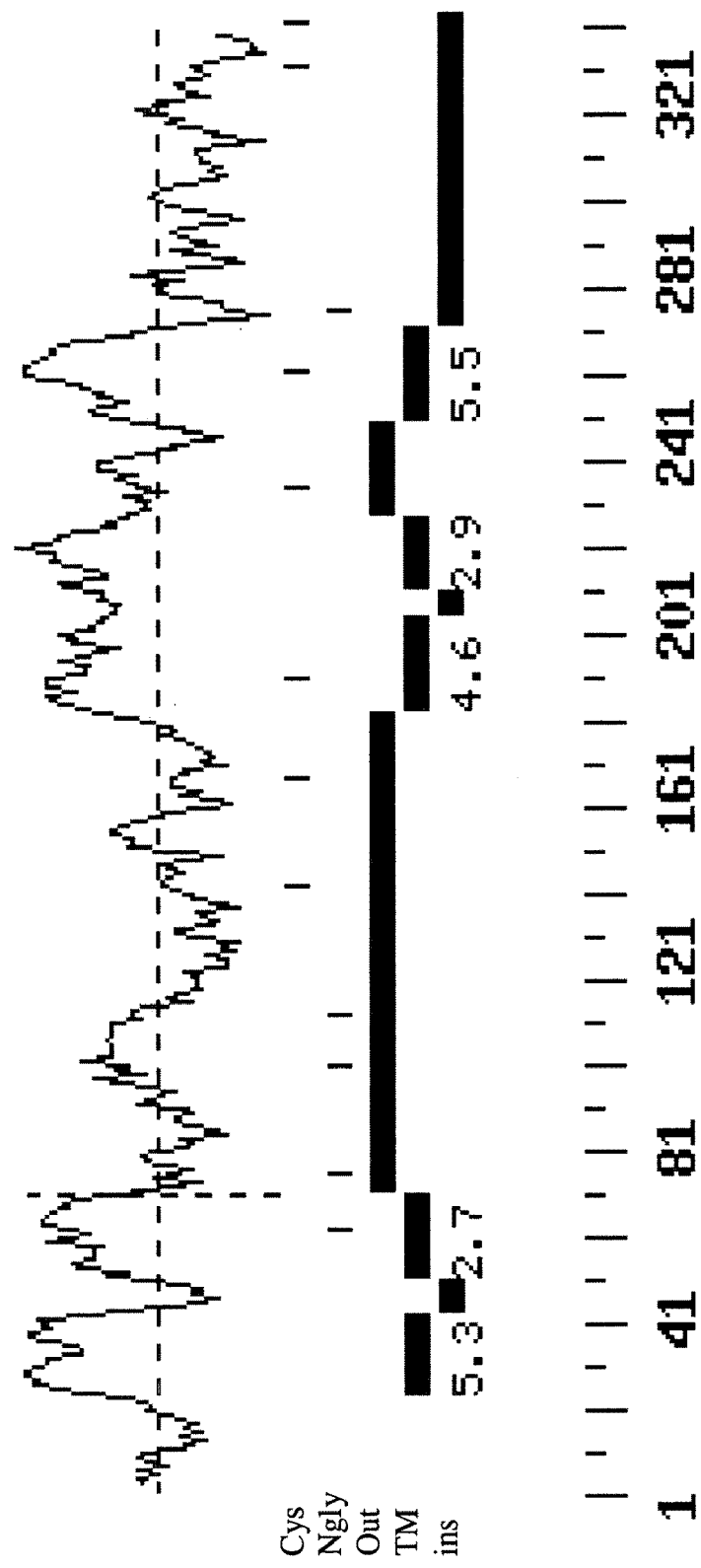

FIG. 69 is a hydrophobicity plot of INTERCEPT 296 protein.

An alignment of the amino acid sequences of human INTERCEPT 296 protein ("296"; SEQ ID NO: 425) and *C. elegans* C06E1.3 related protein ("CRP"; SEQ ID NO: 410) is shown in FIGS. 70A-70B.

DETAILED DESCRIPTION OF THE INVENTION

The present invention is based, at least in part, on the discovery of a variety of cDNA molecules which encode proteins which are herein designated TANGO 202, TANGO 210, INTERCEPT 217, TANGO 229, TANGO 234, TANGO 265, TANGO 276, TANGO 286, INTERCEPT 289, TANGO 292, TANGO 294, INTERCEPT 296, INTERCEPT 297. INTERCEPT 309, TANGO 331, TANGO 332, TANGO 366, INTERCEPT 394, INTERCEPT 400, TANGO 416, MANGO 419, INTERCEPT 429, and TANGO 457. These proteins exhibit a variety of physiological activities, and are included in a single application for the sake of convenience. It is understood that the allowability or non-allowability of claims directed to one of these proteins has no bearing on the allowability of claims directed to the others. The characteristics of each of these proteins and the cDNAs encoding them are described separately in the ensuing sections. In addition to the full length mature and immature proteins described in the following sections, the invention includes fragments, derivatives, and variants of these proteins, as described herein. These proteins, fragments, derivatives, and variants are collectively referred to herein as polypeptides of the invention or proteins of the invention.

TANGO 416

Expression of cDNA encoding a TANGO 416 protein was up-regulated in porcine endothelial cells that were activated using one or more of bacterial lipopolysaccharide, tumor necrosis factor alpha, and human serum. Up-regulation was detected by extracting total RNA from activated cells and subjecting the RNA to reverse transcriptase polymerase chain reaction for differential display. cDNA clones encoding at least a portion of human TANGO 416 protein and corresponding to the porcine TANGO 416 cDNA were isolated from human fetal spleen and osteoblast cDNA libraries (including a clone designated jthsa97d5 obtained from a fetal spleen library, a clone designated jthoc122e2 obtained from an osteoblast library, and a clone designated jthsa121f10 obtained from a fetal spleen library).

Human TANGO 416 protein is a transmembrane protein which can occur in at least two alternative forms, which differ in the presence or absence of a single amino acid residue (i.e. the glutamine residue at amino acid residue 830 of SEQ ID NO: 3 and corresponding nucleotide residues 2863-2865 in SEQ ID NO: 1). In this application, reference to amino acid and nucleotide residues is made to those residues in the longer form of TANGO 416 (i.e. the form having the amino acid sequence SEQ ID NO: 3 and the corresponding cDNA and ORF sequences SEQ ID NOs: 1 and 2, respectively).

The longer form of TANGO 416 has a glutamine residue at amino acid residue 830 that is not present in the shorter form of TANGO 416.

It is understood that both forms of TANGO 416 can exhibit the same biological properties, and that references to amino acid residues numbered 831 or higher in SEQ ID NO: 3 correspond to amino acid residues having the next lower number in SEQ ID NO: 33 (i.e. amino acid residue 901 in the longer form of TANGO 416 {SEQ ID NO: 3} corresponds to amino acid residue 900 in the shorter form of TANGO 416 {SEQ ID NO: 33}). Similarly, references to nucleotide residues numbered 2866 or higher in SEQ ID NO: 1 correspond to nucleotide residues having a number that is lower by 3 in SEQ ID NO: 31 (i.e. nucleotide residue 2903 in the longer form of TANGO 416 {SEQ ID NO: 1} corresponds to nucleotide residue 2900 in the shorter form of TANGO 416 {SEQ ID NO: 31}).

The full length of a cDNA which was isolated from a human fetal spleen cDNA library and which encodes human TANGO 416 protein (SEQ ID NO: 1; i.e. the longer form of TANGO 416) is 5121 nucleotide residues. The open reading frame (ORF) of this cDNA, nucleotide residues 376 to 3780 of SEQ ID NO: 1 (i.e., SEQ ID NO: 2), encodes a 1135-amino acid residue protein (SEQ ID NO: 3), corresponding to a 1108-residue transmembrane mature protein.

The invention thus includes purified human TANGO 416 protein, both in the form of the immature 1135 amino acid residue protein (SEQ ID NO: 3, including the shorter 1134-residue protein {SEQ ID NO: 33}) and in the form of the mature 1108 amino acid residue protein (SEQ ID NO: 5, including the shorter 1107-residue protein {SEQ ID NO: 35}). Mature human TANGO 416 proteins can be synthesized without the signal sequence polypeptide at the amino terminus thereof, or they can be synthesized by generating immature TANGO 416 protein and cleaving the signal sequence therefrom.

The invention includes nucleic acid molecules which encode a polypeptide of the invention. Such nucleic acids include, for example, a DNA molecule having the nucleotide sequence listed in SEQ ID NOs: 1, 2, 31, and 32, such as the portion which encodes a mature TANGO 416 protein, an immature TANGO 416 protein, or a domain of a TANGO 416 protein. These nucleic acids are among the nucleic acids of the invention.

TANGO 416 proteins and nucleic acid molecules encoding them comprise a family of molecules having certain conserved structural and functional features. As used in this disclosure, the term "family" means two or more proteins or nucleic acid molecules having a common or similar domain structure and having sufficient amino acid or nucleotide sequence identity as defined herein. Family members can be from either the same or different species (e.g., human and mouse). For example, a family can comprise two or more proteins of human origin, or can comprise one or more proteins of human origin and one or more of non-human origin.

A common domain present in TANGO 416 proteins is a signal sequence. As used herein, a signal sequence includes a peptide of at least about 10 amino acid residues in length which occurs at the amino terminus of membrane-bound and secreted proteins and which contains at least about 45% hydrophobic amino acid residues such as alanine, leucine, isoleucine, phenylalanine, proline, tyrosine, tryptophan, or valine. In one embodiment, a signal sequence contains at least about 10 to 35 amino acid residues, and has at least about 35-60%, more preferably 40-50%, and more preferably at least about 45% hydrophobic residues. A signal sequence serves to direct a protein containing such a sequence to a lipid bi-layer. Thus, in one embodiment, a TANGO 416 protein contains a signal sequence corresponding to amino acid residues 1 to 27 of SEQ ID NO: 3 and 33 (i.e. SEQ ID NO: 4). It is recognized that the carboxyl terminal boundary of the signal sequence can be located one or two residues from the residue identified above (i.e., following residues 25, 26, 27, 28, or 29 of SEQ ID NOs: 3 and 33). The signal sequence is cleaved during processing of the mature protein.

TANGO 416 proteins include a transmembrane domain and two extra-membrane domains flanking the cell membrane. The transmembrane domain corresponds to about amino acid residues 701 to 721 of SEQ ID NOs: 3 and 33 (i.e., the transmembrane domain having the sequence SEQ ID NO: 7). One of the extra-membrane domains corresponds to about amino acid residues 28 to 700 of SEQ ID NOs: 3 and 33 (i.e. the domain having the sequence SEQ ID NO: 6). The other extra-membrane domain corresponds to about amino acid residues 722 to 1135 of SEQ ID NO: 3 (i.e. residues 722 to 1134 of SEQ ID NO: 33, this domain having the sequence SEQ ID NO: 8 in the longer form of TANGO 416 and SEQ ID NO: 38 in the shorter form). In one embodiment, the extra-membrane domain corresponding to SEQ ID NO: 6 is an extra-cellular domain and the other extra-membrane domain is an intracellular domain. In an alternative embodiment, the extra-membrane domain corresponding to SEQ ID NO: 6 is an intracellular domain and the other extra-membrane domain is an extra-cellular domain.

As used herein, an "extracellular domain" refers to a portion of a protein which is localized to the non-cytoplasmic side of a lipid bi-layer of a cell when a nucleic acid encoding the protein is expressed in the cell. A "transmembrane domain" refers to an amino acid sequence which is at least about 20 to 25 amino acid residues in length and which contains at least about 65-70% hydrophobic amino acid residues such as alanine, leucine, phenylalanine, protein, tyrosine, tryptophan, or valine. As used herein, a "cytoplasmic domain" refers to a portion of a protein which is localized to the cytoplasmic side of a lipid bi-layer of a cell when a nucleic acid encoding the protein is expressed in the cell.

TANGO 416 proteins typically comprise a variety of potential post-translational modification sites and protein domains (often positioned within an extracellular domain), such as those described herein in Table 1, as predicted by computerized sequence analysis of TANGO 416 proteins using amino acid sequence comparison software (comparing the amino acid sequence of TANGO 416 with the information in the PROSITE database {rel. 12.2; February 1995} and the Hidden Markov Models database {Rel. PFAM 3.3}).

TABLE I

| Type of Potential Modification Site or Domain | Amino Acid Residues of SEQ ID NO: 3 | Amino Acid Sequence |
|---|---|---|
| N-glycosylation site | 103 to 106 | NCSI |
| | 269 to 272 | NATD |
| | 420 to 423 | NATL |
| | 559 to 562 | NTTV |
| | 583 to 586 | NNTA |
| | 641 to 644 | NVSM |
| | 766 to 769 | NGTL |
| | 816 to 819 | NFSL |
| cAMP/cGMP-dependent protein kinase phosphorylation site | 728 to 731 | KKDT |
| | 748 to 751 | KRPS |
| | 979 to 982 | KKKS |
| Protein kinase C phosphorylation site | 63 to 65 | TVR |
| | 290 to 292 | SPK |
| | 296 to 298 | TFK |
| | 301 to 303 | SER |
| | 447 to 449 | TVK |
| | 552 to 554 | SPK |
| | 848 to 850 | SFR |
| | 857 to 859 | SYR |
| | 869 to 871 | SLK |
| | 873 to 875 | SGR |
| | 1082 to 1084 | SSK |
| Casein kinase II phosphorylation site | 160 to 163 | SAFD |
| | 177 to 180 | SAND |
| | 188 to 191 | TRTD |
| | 210 to 213 | SSYE |
| | 217 to 220 | TASD |
| | 235 to 238 | SISD |
| | 271 to 274 | TDPD |
| | 468 to 471 | SRYE |
| | 488 to 491 | TATD |
| | 503 to 506 | TILE |
| | 565 to 568 | TIID |
| | 650 to 653 | TEWE |
| | 869 to 872 | SLKD |
| | 883 to 886 | SDYD |
| | 891 to 894 | SPID |
| | 966 to 969 | SLED |
| | 990 to 993 | SPND |
| | 1022 to 1025 | TYSE |
| | 1027 to 1030 | SEVD |
| Tyrosine Kinase Phosphorylation Site | 187 to 195 | RTRTDGAKY |
| | 409 to 415 | KTYENNY |
| | 726 to 734 | REKKDTRSY |
| | 737 to 743 | RVAESTY |
| N-myristoylation site | 41 to 46 | GSVIAR |
| | 192 to 197 | GAKYAE |
| | 481 to 486 | GAYITT |
| | 511 to 516 | GSSITT |
| | 525 to 530 | GAIYAL |
| | 593 to 598 | GAESGF |
| | 623 to 628 | GNEENI |
| | 707 to 712 | GAICAV |
| | 788 to 793 | GQMGSR |
| | 851 to 856 | GNKYSR |
| | 1074 to 1079 | GTHSSV |
| Cell Attachment Sequence | 875 to 877 | RGD |
| Zinc Carboxypeptidase Zinc-Binding Region 2 Signature | 639 to 649 | HTNVSMDSVPY |
| Cadherin Extracellular Repeated Domain Signature | 125 to 135 | VEVLDINDNSP |
| | 234 to 244 | ISISDSNDNSP |
| | 342 to 352 | IKVVDVNDNKP |
| | 453 to 463 | VQIINDINDNPP |
| | 564 to 574 | LTIIDENDNVP |

As used herein, the term "post-translational modification site or domain" refers to a protein region that includes about 3 to 10 amino acid residues, more preferably about 3 to 6 amino acid residues wherein the domain has an amino acid sequence which comprises a consensus sequence which is recognized and modified by a protein-modifying enzyme. The term also includes protein domains having greater lengths, as indicated herein. Examples of protein-modifying enzymes include amino acid glycosylases, cAMP- and cGMP-dependent protein kinases, protein kinase C, casein kinase II, tyrosine kinase, myristoylases, and prenyl transferases. In various embodiments, the protein of the invention has at least 1, 2, 4, 6, 10, 15, 20, 30, 40, or 50 or more of the post-translational modification sites described herein in Table I. In one embodiment, the protein of the invention has all 63 of the sites described in Table I Examples of additional domains present in human TANGO 416 protein include cadherin extracellular repeated domains. In one embodiment, the protein of the invention has at least one domain or signature sequence that is at least 55%, preferably at least about 65%, 75%, 85%, or 95% identical to one of the cadherin extracellular domains or signature sequences described herein in Table I. Preferably, the protein of the invention has 2, 3, 4, or all 5, cadherin extracellular repeated domains.

Cadherin extracellular repeated domains have a conserved consensus sequence that occurs in numerous cadherins. The conserved extracellular cadherin repeated domain sequence, which is frequently repeated in cadherins is {L or I or V}-X-{L or I or V}-X$_{(1\ or\ 2)}$-D-X—N-D-{N or H}-X—P, (SEQ ID NO: 450) where X is any amino acid residue, and wherein the subscript '1 or 2' indicates that either one or two X residues can be present at that position. Folding of the extracellular repeated domain of cadherins is believed to roughly correspond to occurrence of extracellular cadherin repeated domains.

Cadherins are a family of cell-surface proteins which are involved in cell-to-cell binding, including specific cell adhesion processes which occur during development and adherens junction formation related to tissue organization in developing and adult organisms. Cadherins are also involved in intracellular signaling. Repeated cadherin extracellular domains occur in a variety of cadherins, including, for example, epithelial cadherin (sometimes designated E-cadherin, uvomorulin, L-CAM, or CDH1), neural cadherin (sometimes designated N-cadherin or CDH2), placental cadherin (sometimes designated P-cadherin or CDH3), retinal cadherin (sometimes designated R-cadherin or CDH4), vascular endothelial cadherin (sometimes designated VE-cadherin or CDH5), kidney cadherin (sometimes designated K-cadherin or CDH6), cadherin-8 (sometimes designated CDH8), osteoblast cadherin (sometimes designated OB-cadherin or CDH11), brain cadherin (sometimes designated BR-cadherin or CDH12), truncated cadherin (sometimes designated T-cadherin or CDH13), muscle cadherin (sometimes designated M-cadherin or CDH14), liver-intestine cadherin (sometimes designated LI-cadherin), and EP-cadherin. Occurrence of repeated cadherin extracellular domains in TANGO 416 is an indication that TANGO 416 is a member of the cadherin family of proteins, and is thus involved in specific cell adhesion processes and regulation of intracellular signaling events in tissues in which it occurs.

The signal peptide prediction program SIGNALP (Nielsen et al. (1997) Protein Engineering 10:1-6) predicted that human TANGO 416 protein includes a 27 amino acid residue signal peptide (amino acid residues 1 to 27 of SEQ ID NOs: 3 and 33 {SEQ ID NO: 4}) preceding the mature TANGO 416 protein (about amino acid residues 28 to 1135 of SEQ ID NO: 3 {SEQ ID NO: 5} and about amino acid residues 28 to 1134 of SEQ ID NO: 33 {SEQ ID NO: 35}). Human TANGO 416 protein includes an extracellular domain (about amino acid residues 28 to 700 of SEQ ID NOs: 3 and 33 {SEQ ID NO: 6}), a transmembrane domain (about amino acid residues 701 to 721 of SEQ ID NOs: 3 and 33 {SEQ ID NO: 7}), and an intracellular domain (about amino acid residues 722 to 1135 of SEQ ID NO: 3 {SEQ ID NO: 8} and about amino acid residues 722 to 1134 of SEQ ID NO: 33 {SEQ ID NO: 38}).

Figure 1:
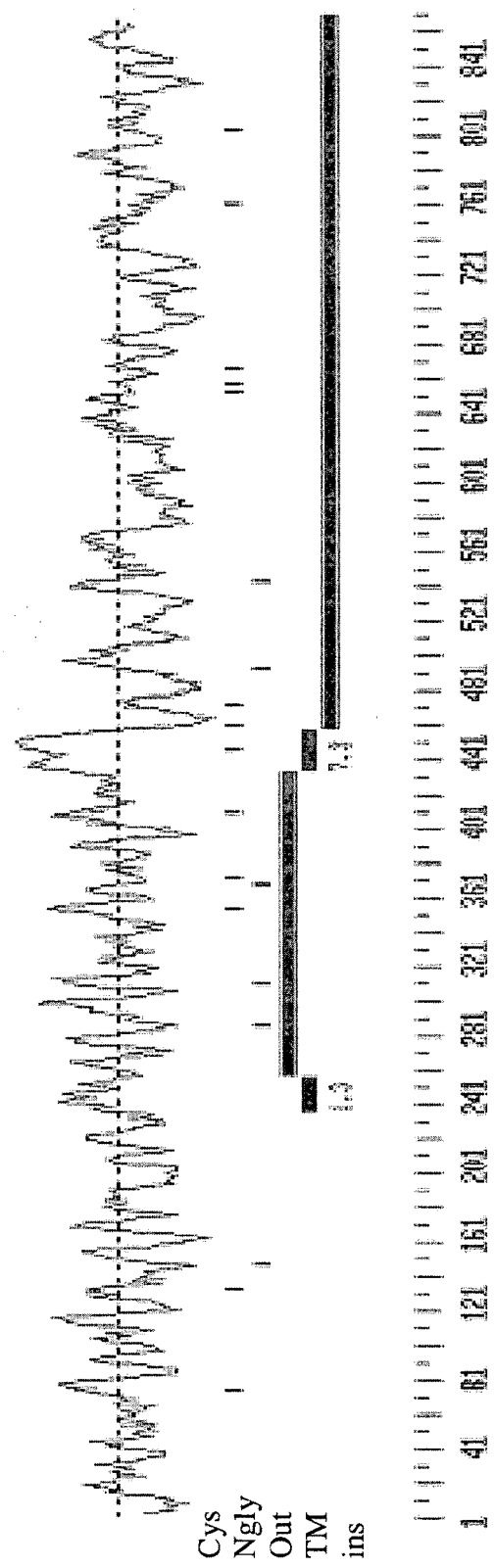
FIG. 1 is a hydrophobicity plot of the embodiment of human TANGO 416 protein listed in SEQ ID NO: 3. In the hydrophobicity plots disclosed herein, the locations of cysteine residues ("Cys") and potential N-glycosylation sites ("Ngly") are indicated by vertical bars and the predicted extracellular ("out"), intracellular ("ins"), or transmembrane ("TM") portions of the protein backbone are indicated by a horizontal bar. Relatively hydrophobic regions of the protein are above the dashed horizontal line, and relatively hydrophilic regions of the protein are below the dashed horizontal line.

FIG. 1 depicts a hydrophobicity plot of human TANGO 416 protein. Relatively hydrophobic regions are above the dashed horizontal line, and relatively hydrophilic regions are below the dashed horizontal line. The hydrophobic region which corresponds to amino acid residues 1 to 27 of SEQ ID NOs: 3 and 33 is the signal sequence of human TANGO 416 (SEQ ID NO: 4). As described elsewhere herein, relatively hydrophilic regions are generally located at or near the surface of a protein, and are more frequently effective immunogenic epitopes than are relatively hydrophobic regions. For example, the region of human TANGO 416 protein from about amino acid residue 450 to about amino acid residue 470 appears to be located at or near the surface of the protein, while the region from about amino acid residue 335 to about amino acid residue 345 appears not to be located at or near the surface.

The predicted molecular weight of human TANGO 416 protein without modification and prior to cleavage of the signal sequence is about 126.0 kilodaltons. The predicted molecular weight of the mature human TANGO 416 protein without modification and after cleavage of the signal sequence is about 122.8 kilodaltons.

TANGO 416 DNA maps to chromosome 4, between chromosomal markers D4S422 and D4S 1576, as assessed by comparing TANGO 416 sequence with an ESTs in a mapping database. Other genes which map to this chromosomal segment include those encoding endothelin-1 receptor precursor, surfactant protein A, transforming growth factor beta signaling protein-1 (Bsp-1), and a gene highly similar to *Mus musculus* hemoglobin zeta chain. Thus, disorders previously attributed to these loci by others can also be attributable to the chromosomal portion encoding TANGO 416.

cDNA encoding TANGO 416 protein occurs in cDNA libraries generated from human fetal spleen tissue and from human osteoblasts. High homology of TANGO 416 cDNA was observed with expressed sequence tags (ESTs) obtained from EST libraries generated from human fetal heart, human fetal lung, human testis, human pancreas, human prostate, and human B cell tissues, indicating that TANGO 416 protein can be expressed in these tissues as well.

Residues 1651-4000 of SEQ ID NO: 1 (the nucleotide sequence of TANGO 416 cDNA) were aligned (using the ALIGN software with gap length penalty of 12, and a gap penalty of 4) with the nucleotide sequence of the human testis cDNA clone DKFZp434B0923 listed in GenBank accession number AL137471. This alignment, shown in FIG. 2A-2H, was generated using the ALIGN software (using the BLOSUM62 scoring matrix, a gap opening penalty of 12, a gap extension penalty of 4, and a frameshift gap penalty of 5), and indicated 98.6% identity between the two sequences in the 2350-residue overlapping portion. The nucleotide sequence (SEQ ID NO: 2) of the ORF encoding TANGO 416 was aligned using the ALIGN software (with gap length penalty of 12, and a gap penalty of 4)) with the nucleotide sequence of the ORF of a murine protocadherin (GenBank™ accession number Y08715; Telo et al., 1998, J.

Biol. Chem. 273:17565-17572), as shown in FIGS. 3A-3O. This alignment was generated using the ALIGN software (using the BLOSUM62 scoring matrix, a gap opening penalty of 12, a gap extension penalty of 4, and a frameshift gap penalty of 5), and indicated 55.4% identity between the two sequences in the overlapping portion. Alignment of the amino acid sequence of TANGO 416 with the amino acid sequence of the murine protocadherin, as shown in FIGS. 4A-4E, indicated 32.8% sequence identity and 42.2% sequence similarity. This alignment was generated using the ALIGN software (using the BLOSUM62 scoring matrix, a gap opening penalty of 12, a gap extension penalty of 4).

Uses of TANGO 416 Nucleic Acids, Polypeptides, and Modulators Thereof

TANGO 416 proteins are involved in disorders which affect both tissues in which they are normally expressed and tissues in which they are normally not expressed. Based on the observations that cDNA corresponding to TANGO 416 occurs in human fetal spleen and human osteoblast cDNA libraries, and that ESTs corresponding to portions of TANGO 416 can be detected in ESTs prepared from each of human fetal heart, human fetal lung, human testis, human pancreas, human prostate, and human B cell tissues, TANGO 416 protein can be involved in one or more biological processes which occur in these tissues. In particular, TANGO 416 can be involved in modulating growth, proliferation, survival, differentiation, adhesion, and activity of cells of these tissues. Furthermore, because TANGO 416 likely belongs to the cadherin family of proteins, it can also be involved in modulating movement of cells (e.g., T cells and other cells of the immune system) through tissues which express receptors for TANGO 416 (e.g. cells which express one or more cadherin receptors, e.g., cells which express integrin αEβ7).

Integrin αEβ7 (sometimes designated αE/HML-1, αE/human mucosal lymphocyte-1 and CD103, and described in international patent application publication number WO95/22610, published on Aug. 24, 1995) is an integrin protein which is expressed by more than 90% of intestinal epithelial lymphocytes, on 40-50% of intestinal lamina propria T lymphocytes, and on about 2% of peripheral blood leukocyte. Integrin αEβ7 is also expressed by T lymphocytes at other mucosal epithelia and on about 40% of T cells obtained by bronchioalveolar lavage. Integrin αEβ7 is apparently not expressed on B cells. A putative endothelial ligand designated E-cadherin binds with integrin αEβ7. Antibodies which bind specifically with the αE subunit of integrin αEP7 have demonstrated efficacy for treatment of inflammatory bowel disease and for reducing pulmonary inflammation and airway hyper-responsiveness in murine models of these disorders. Integrin αEβ7 is believed to have a role in binding of lymphocytes with endothelial cells and with regulation of tissue levels of $T_H1$ and $T_H2$ cytokines (e.g. IL-5, IL-13) and eotaxin. The ability of TANGO 416 to bind with integrin αEβ7 indicates that TANGO 416 protein and other TANGO 416-related molecules can be used to modulate the physiological activities associated with integrin αEβ7 function and to treat disorders to which such physiological activities contribute.

In one embodiment of the invention, TANGO 416-related molecules are used to modulate interaction of cells which normally express integrin αEβ7 (e.g. binding with, movement over, among, or past, or activation of cellular function by) and cells which normally express TANGO 416. TANGO 416-related molecules can also be used to modulate production, release, or both, of cytokines and eotaxin by cells which normally express integrin αEβ7. TANGO 416 protein can thus be involved in disorders which affect epithelial and lymphocytic tissues. Such disorders include cell proliferation disorders, disorders associated with aberrant epithelial permeability, auto-, hypo-, and hyper-immune disorders, disorders associated with aberrant binding or adhesion of cells with other cells, and inflammatory disorders. TANGO 416-related molecules can be used to prognosticate, prevent, diagnose, or treat one or more such disorders. Examples of these disorders include acute and chronic inflammatory diseases of the bowel, colitis of various etiologies, gastrointestinal infections, gastritis, gastroesophageal reflux disorder, acute and chronic peritonitis, appendicitis, diarrhea, constipation, gastroenteritis, hemorrhoids, proctitis, chronic and acute bronchitis, asthma, pneumonia, hypersensitivity pneumonitis, allergic disorders, anemia, leukopenia, thrombocytopenia, lymphoproliferative diseases, transplant rejection, graft-versus-host reactions, allergic reactions, hypersplenism, autoimmune disorders, metastasis of tumor tissue, cystic fibrosis, various chronic obstructive pulmonary disorders, pericarditis, hypogonadism, and testosterone deficiency syndrome.

Other disorders which can be treated using TANGO 416 proteins, nucleic acids encoding them, and agents that modulate activity or expression of either of these include disorders of bone and cartilage tissues (e.g., traumatic and degenerative injuries), disorders of the spleen (e.g., lymphoma and splenomegaly), disorders associated with aberrant processing of blood cells in splenic tissue (e.g., disorders involving aberrant macrophage activity), cardiovascular disorders (e.g., disorders of the cardiac muscle and disorders of blood vessels), disorders involving aberrant association (or non-association) of B and T lymphocytes with each other and with endothelial tissues (e.g., immune disorders and inflammatory disorders), pancreatic disorders (e.g., pancreatitis, pancreatic cysts, pancreatic tumors, diabetes mellitus, and islet cell tumors), and disorders of the prostate (e.g., inflammatory prostatic diseases, prostatic hyperplasia, and prostate tumors).

TANGO 416 can interact as a ligand with integrin αEβ7, as discussed above.

Integrin αEβ7 (also designated human mucosal lymphocyte 1 antigen or CD103) is expressed on more than 90% of intestinal epithelial lymphocytes (IEL), and about 40-50% of intestinal lamina propria T lymphocytes, but only on about 2% of peripheral blood leukocytes. Integrin αEβ7 is also expressed on T lymphocytes which are present at other mucosal epithelial (e.g. on about 40% of T cells recovered by bronchioalveolar lavage {BAL}). Integrin αEβ7 does not appear to be expressed on B lymphocytes. Transforming growth factor beta 1 (TGF-β1) induces expression of integrin αEβ7 on both T lymphocytes and cultured murine mast cells.

Antibodies which bind specifically with integrin αEβ7 reduce morbidity and pathological effects associated with experimentally induced inflammatory bowel disease (IBD; e.g. using the CD45Rb$^{hi}$SCID transfer model of IBD), transmural colitis, (e.g. using interleukin-2 {IL-2} knockout mice immunized using 2,4,6-trinitrophenol), and pulmonary inflammation (e.g. using mice sensitized intraperitoneally with and challenged with aerosol ovalbumin). In BAL fluids obtained from mice which were sensitized and challenged with ovalbumin and to which anti-integrin αEβ7 were administered, decreased numbers of eosinophils and leukocytes were detected, and levels of $T_H2$ cytokines (e.g. IL-5 and IL-13) and eotaxin were decreased as well. Integrin αEβ7 knockout (i.e. nullizygous) mice exhibited decreased numbers of intestinal epithelial lymphocytes, decreased susceptibility to pulmonary inflammation, reduced airway hyper-responsiveness, and decreased levels of $T_H2$ cytokines in BAL fluids. These data indicate that integrin αEβ7 can function as a receptor for guiding lymphocytes (e.g. T cells, mast cells, and eosinophils) to mucosal epithelia and maintaining them at those locations. These data also indicate that integrin αEβ7 can modulate $T_H1$ and $T_H2$ cytokine levels in tissues which contain integrin αEβ7-bearing cells (see international patent application publication number W095/22610, published on Aug. 24, 1995).

TANGO 416 proteins can bind with integrin αEβ7 and thereby modulate the integrin's physiological effects. In particular, TANGO 416 proteins can modulate localization of integrin αEβ7-bearing lymphocytes at tissues which express TANGO 416 (e.g. at mucosal epithelia such as intestinal and pulmonary epithelia) and release and maintenance of $T_H1$ and $T_H2$ cytokine levels in or near such tissues. Modulation of cytokine levels by TANGO 416 can, in turn, modulate proliferation, activity, and migration of cells of the immune system, such as are associated with a variety of inflammatory, autoimmune, hypo-immune, and hyper-immune disorders. TANGO 416 proteins, nucleic acids encoding them, and agents that modulate activity or expression of either of these can thus be used to modulate these processes.

Disorders that involve proliferation, activity, and migration of immune cells in the vicinity of mucosal epithelia include, by way of example, acute and chronic inflammatory diseases of the bowel (e.g. inflammatory bowel disease and Crohn's disease), colitis (of various etiologies), gastrointestinal infections (e.g. formation and perseverance of peptic ulcers), gastritis, gastroesophageal reflux disorder, acute and chronic peritonitis, appendicitis, diarrhea, constipation, gastroenteritis, hemorrhoids, and proctitis. Such disorders also include disorders that involve proliferation, activity, and migration of immune cells in the vicinity of pulmonary mucosal epithelial, such as chronic and acute bronchitis, asthma, pneumonia (e.g. pneumococcal, staphylococcal, streptococcal, klebsiellal, hemophilal, viral, fungal, etc.), hyper-sensitivity pneumonitis, and allergic disorders (e.g. hay fever and the like). TANGO 416 proteins, nucleic acids encoding them, and agents that modulate activity or expression of either of these can thus be used to prognosticate, diagnose, and treat one or more of these disorders.

Expression of TANGO 416 in osteoblasts is an indication that TANGO 416 can have a role in modulating bone formation, marrow cell differentiation and proliferation, and proliferation, differentiation, function, or some combination of these, of bone and cartilage cells. Examples of disorders which can be prognosticated, diagnosed, and treated using TANGO 416 proteins, nucleic acids encoding them, and agents that modulate activity or expression of either of these include disorders of bone and cartilage tissues including bone or cartilage injuries, such as those attributable to trauma (e.g., bone breakage and cartilage tearing), or to degeneration (e.g., osteoporosis and age-related degradation of cartilage). The compositions can also be used to treat disorders associated with degeneration of joints, such as arthritis (including rheumatoid arthritis), osteoarthritis, and bone wearing.

Occurrence of TANGO 416 cDNA in a fetal spleen library is an indication that TANGO 416 proteins, nucleic acids encoding them, and agents that modulate activity or expression of either of these can be used to modulate proliferation, differentiation, function, or some combination of these, of spleen cells (e.g., cells of the splenic connective tissue, splenic smooth muscle cells, and endothelial cells of splenic blood vessels). These compositions can thus be used to treat disorders of the spleen, (including both the fetal spleen and the adult spleen). Examples of splenic diseases and disorders include splenic lymphoma and splenomegaly. Occurrence of TANGO 416 in splenic tissue further indicates that TANGO 416 proteins, nucleic acids encoding them, and agents that modulate activity or expression of either of these can be used to modulate proliferation, differentiation, function, or some combination of these, of blood cells that are processed in splenic tissue. These cells include cells which are regenerated or phagocytized within the spleen, including, for example, erythrocytes, B and T lymphocytes, and macrophages. Examples of these disorders include phagocytotic disorders, such as disorders in which engulfinent of bacteria and viruses in the bloodstream by macrophages in the spleen is inhibited.

Occurrence in a fetal heart library of an EST which exhibits homology with cDNA encoding TANGO 416 indicates that TANGO 416 proteins, nucleic acids encoding them, and agents that modulate activity or expression of either of these can be used to treat cardiovascular disorders, including disorders of the heart and disorders of the blood vessels. Examples of cardiac disorders which can be treated in this manner include ischemic heart diseases (e.g., angina pectoris, myocardial infarction and its aftermath, coronary artery disease, cardiac arrest, and chronic ischemic heart disease), hypertensive heart disease, pulmonary heart disease, valvular heart disease (e.g., rheumatic fever and rheumatic heart disease, endocarditis, mitral valve prolapse, and aortic valve stenosis), congenital heart disease (e.g., valvular and vascular obstructive lesions, atrial or ventricular septal defect, and patent ductus arteriosus), cardiac arrhythmia, cardiac insufficiency, endocarditis, pericardial disease, muscular dystrophy, and myocardial disease (e.g., myocarditis, congestive cardiomyopathy, restrictive cardiomyopathy, and hypertrophic cardiomyopathy). Examples of vascular disorders which can be treated in this manner include arteriosclerosis, atherosclerosis, hypertension, aberrant or non-desired angiogenesis, stenosis and restenosis, and smooth muscle proliferation in response to traumatic injury.

Involvement of TANGO 416 protein in binding of cells is an indication that TANGO 416 can be involved in disorders associated with aberrant binding or adhesion of cells with other cells, with extracellular matrix, or with foreign materials. Disorders involving aberrant binding or adhesion of cells with other cells include both disorders in which cells normally bind with one another (e.g., metastasis of normally solid tumor tissue cells away from the tumor site of origin or immune hypersensitivity) and disorders in which the cells do not normally bind with one another, but do bind with one another in individuals afflicted with the disorder (e.g., metastasis of tumor cells into a tissue in which the cells do not normally occur, autoimmune disorders infections, wherein cells with which T cells bind are not normally present in the animal, or disorders associated with abnormal blood coagulation). Disorders involving aberrant binding or adhesion of cells with tissue on which TANGO 416 is normally expressed, include those in which the cells normally do, but aberrantly do not, bind with TANGO 416-expressing tissue as well as those (e.g., metastasis of cancers cells into mucosal epithelium) in which the cells normally do not bind with TANGO 416-expressing tissue, but aberrantly do. TANGO 416 proteins, nucleic acids encoding them, and agents that modulate activity or expression of either of these can be used to prognosticate, diagnose, and treat one or more of these disorders.

Like many transmembrane signaling proteins, TANGO 416 protein comprises extracellular domains capable of interacting with environmental cues (e.g., the presence or absence of particular cells, proteins, or small molecules) and a cytoplasmic domain having a substantial size. Numerous cadherins interact with catenins, tyrosine kinases, and other proteins which can influence the structure of the intracellular matrix. TANGO 416 can also interact with such proteins, and the existence of numerous post-translationally modifiable sites (see Table I) on TANGO 416 is an indication that TANGO 416 can be involved in transducing signals across the cell membrane. Binding of a ligand of TANGO 416 protein (e.g. integrin αEβ7 on the surface of a different cell such as a leukocyte) with a portion of the protein located on one side of the membrane can affect one or more characteristics (e.g., conformation, phosphorylation state, or level or specificity of enzymatic activity) of a portion of the TANGO 416 protein located on the other side. Thus, for example, a compound in the extracellular environment of a cell which expresses TANGO 416 can bind with the extracellular domain of the protein, thereby effecting a change in a characteristic of the intracellular portion of the protein, leading to alteration of the physiology of the cell (e.g., effected by an activity exerted by the intracellular portion of the protein on another component of the cell). The compound in the extracellular environment can, for example, be a compound dissolved or suspended in a liquid, a compound attached to another cell of the same animal, or a compound attached to a foreign cell or virus particle.

TANGO 416 protein can associate with other signal transduction proteins in the cell membrane, thereby modulating the intracellular activity of those other proteins. TANGO 416 can also bind with a membrane-bound protein (e.g. integrin αEβ7) of another cell, thereby modulating physiological activities associated with signal transduction mediated by that membrane-bound protein. By way of example, signal transduction events associated with integrin αEβ7 include modulation of TH 1 and $T_H2$ cytokine (and eotaxin) production and release by leukocytes and movement and adherence of leukocytes. TANGO 416 protein and fragments and variants thereof can modulate such activities. TANGO 416 proteins can thus have a role in disorders which involve aberrant transmembrane signal transduction. Examples of signal transduction-related disorders include cystic fibrosis, various chronic obstructive pulmonary disorders, lymphocyte localization and activation disorders (e.g. transmural colitis, airway hyper-responsiveness, and various allergic disorders), and inflammatory disorders such as inflammatory bowel disease. TANGO 416 proteins, nucleic acids encoding them, and agents that modulate activity or expression of either of these can be used to prognosticate, diagnose, and treat one or more of these disorders.

Occurrence of ESTs which exhibit homology with TANGO 416 nucleic acids in EST libraries generated from tissues which comprise endothelial tissues (e.g. fetal heart tissue and testicular tissue) indicates that TANGO 416-related molecules can be used to prognosticate, diagnose, and treat one or more other disorders which afflict endothelial tissues and organs which contain them. By way of example, the heart is surrounded by an endothelial pericardium which can become inflamed, leading to pericarditis and other complications. Similarly, the endothelial lining of blood vessels is known to bind lymphocytes (e.g. during 'rolling' movement of lymphocytes through the vessel and during extravasation of lymphocytes). Disorders which can affect testicular endothelium include hypogonadism and testosterone deficiency syndrome. Interaction of one or more TANGO 416-related molecules with cells that modulate interaction of TANGO 416 with integrin αEβ7 cells can inhibit, prevent, or alleviate such disorders. Furthermore, interaction of TANGO 416-related molecules with sample material (e.g. blood or tissue) obtained by a patient can be used to diagnose such disorders.

Homology of an EST obtained from a human B cell EST library with a TANGO 416 nucleic acid is an indication that TANGO 416 can modulate disorders involving inappropriate interaction of B and T cells. Such disorders include hypo-, hyper-, and auto-immune disorders and also include inflammatory disorders. By modulating interactions of B and T lymphocytes with each other and with endothelial tissues (and other tissues which can express integrin αEβ7, TANGO 416 proteins, nucleic acids encoding them, and agents that modulate activity or expression of either of these can also be used to treat immune disorders and inflammatory disorders. By way of example, they can be used to treat autoimmune disorders (e.g., arthritis, graft rejection such as allograft rejection), T cell disorders (e.g., AIDS)), bacterial infection, psoriasis, bacteremia, septicemia, cerebral malaria, inflammatory bowel disease, arthritis (e.g., rheumatoid arthritis, osteoarthritis), and allergic inflammatory disorders (e.g., asthma or psoriasis).

Homology of an EST of a library made using cDNA obtained from pancreatic tissue with TANGO 416 cDNA sequence indicates that TANGO 416 proteins, nucleic acids encoding them, and agents that modulate activity or expression of either of these can be used to treat pancreatic disorders. Examples of pancreatic disorders which can be treated in this manner include pancreatitis (e.g., acute hemorrhagic pancreatitis and chronic pancreatitis), pancreatic cysts (e.g., congenital cysts, pseudocysts, and benign or malignant neoplastic cysts), pancreatic tumors (e.g., pancreatic carcinoma and adenoma), diabetes mellitus (e.g., insulin- and non-insulin-dependent types, impaired glucose tolerance, and gestational diabetes), and islet cell tumors (e.g., insulinomas, adenomas, Zollinger-Ellison syndrome, glucagonomas, and somatostatinoma).

cDNA encoding TANGO 416 also exhibits homology with an EST of a library made using cDNA obtained from prostate tissue. Thus, TANGO 416 proteins, nucleic acids encoding them, and agents that modulate activity or expression of either of these can be used to treat prostate disorders. Examples of prostate disorders which can be treated in this manner include inflammatory prostatic diseases (e.g., acute and chronic prostatitis and granulomatous prostatitis), prostatic hyperplasia (e.g., benign prostatic hypertrophy or hyperplasia), and prostate neoplasms and tumors (e.g., carcinomas).

Homology of TANGO 416 protein with murine vascular endothelial cadherin-2 (mVE-cad-2; Telo et al., 1998, J. Biol. Chem. 273:17565-17572; GenBank™ accession number Y08715; sometimes designated protocadherin; see FIGS. 3A-3O and 4A-4E) is an indication that TANGO 416 is a human orthologue of that mVE-cad-2, and exhibits one or more of the same activities. That is, TANGO 416 can be involved in adherens junction formation and maintenance, and can thereby modulate endothelial permeability to plasma proteins and circulating cells.

TANGO 457

The TANGO 457 proteins and nucleic acid molecules comprise families of molecules having certain conserved structural and functional features.

For example, the TANGO 457 proteins of the invention can have signal sequences. In certain embodiments, a TANGO 457 polypeptide can include the amino acid sequence SEQ ID NO: 55 at its amino terminus, and the signal sequence is located at amino acids 1 to 21, 1 to 22, 1 to 23, 1 to 24, 1 to 25, 1 to 26, or 1 to 27 of SEQ ID NO: 53. In such embodiments of the invention, the domains and the mature protein resulting from cleavage of such signal peptides are also included herein. For example, the cleavage of a signal sequence consisting of amino acids 1 to 24 of SEQ ID NO: 53 (SEQ ID NO: 55) results in a cytoplasmic domain consisting of amino acids 25 to 264, a transmembrane domain consisting of amino acids 265 to 282, an extracellular domain consisting of amino acids 283 to 365, of SEQ ID NO: 53 (SEQ ID NO: 56, 59, and 60, respectively) and the mature TANGO 457 protein corresponding to amino acids 25 to 365 of SEQ ID NO: 53 (SEQ ID NO: 54). The signal sequence is normally cleaved during processing of the mature protein.

A TANGO 457 family member can include one or more of the following domains: (1) an extracellular domain; (2) a transmembrane domain; and (3) a cytoplasmic domain. For example, in one embodiment, a TANGO 457 protein contains a cytoplasmic domain at about amino acid residues 1 to 264 of SEQ ID NO: 53 (SEQ ID NO: 56), a transmembrane domain at about amino acid residues 265 to 282 of SEQ ID NO: 53 (SEQ ID NO: 59), and an extracellular domain at about amino acid residues 283 to 365 of SEQ ID NO: 53 (SEQ ID NO: 60). In another embodiment, a human TANGO 457 protein contains an cytoplasmic domain at amino acid residues 283 to 365 of SEQ ID NO: 53 (SEQ ID NO: 60), a transmembrane domain at amino acid residues 265 to 282 of SEQ ID NO: 53 (SEQ ID NO: 59), and an extracellular domain at amino acid residues 1 to 264 of SEQ ID NO: 53 (SEQ ID NO: 56).

A TANGO 457 family member can include one or more TANGO 457 Ig domains. A TANGO 457 Ig domain as described herein is about 68 to 84 amino acid residues in length and has the following consensus sequence, beginning about 1 to 15 amino acid residues, more preferably about 3 to 10 amino acid residues, and most preferably about 5 amino acid residues from the domain C-terminus: [FYL]-X—C—X-[VA], wherein [FYL] is a phenylalanine, tyrosine or leucine residue (preferably tyrosine), where "X" is any amino acid, C is a cysteine residue, and [VA] is an alanine residue or a valine residue. In one embodiment, a TANGO 457 family member includes one or more Ig domains having an amino acid sequence that is at least about 55%, preferably at least about 65%, more preferably at least about 75%, yet more preferably at least about 85%, and most preferably at least about 95% identical to amino acids 41 to 124 of SEQ ID NO: 53 (SEQ ID NO: 57). In another embodiment, a TANGO 457 family member includes one or more Ig domains having an amino acid sequence that is at least about 55%, preferably at least about 65%, more preferably at least about 75%, yet more preferably at least about 85%, and most preferably at least about 95% identical to amino acids 163 to 230 of SEQ ID NO: 53 (SEQ ID NO: 58).

In another embodiment, a TANGO 457 family member includes one or more TANGO 457 Ig domains having an amino acid sequence that is at least about 55%, preferably at least about 65%, more preferably at least about 75%, yet more preferably at least about 85%, and most preferably at least about 95% identical to amino acids 41 to 124 and/or 163 to 230 of SEQ ID NO: 53 (SEQ ID NO: 57 and 58), and has a conserved cysteine residue about 1 to 15, preferably 1 to 10, more preferably 1 to 8 residues downstream from the N-terminus of the Ig domain. Thus, in this embodiment, amino acids 48 and 163 of SEQ ID NO: 53 are cysteine residues.

In another embodiment, a TANGO 457 family member includes one or more TANGO 457 Ig domains having an amino acid sequence that is at least 55%, preferably at least about 65%, more preferably at least about 75%, yet more preferably at least about 85%, and most preferably at least about 95% identical to amino acids 41 to 124 and/or 163 to 230 of SEQ ID NO: 53 (SEQ ID NO: 57 and 58), and has a conserved cysteine residue about 1 to 8 residues downstream from the N-terminus of the TANGO 457 Ig domain, has a conserved cysteine within the consensus sequence that forms a disulfide with said first conserved cysteine, and has at least one TANGO 457 biological activity as described herein.

A cDNA encoding human TANGO 457 was identified by analyzing the sequences of clones present in a human uterine smooth muscle library for sequences that encode wholly secreted or transmembrane proteins. This analysis led to the identification of a clone, jthUa027h12, encoding human TANGO 457. The human TANGO 457 cDNA of this clone is 2330 nucleotides long (SEQ ID NO: 51). The open reading frame of TANGO 457 comprises nucleotides 149 to 1243 of SEQ ID NO: 51 (SEQ ID NO: 52), and encodes a transmembrane protein comprising the 365 amino acid sequence depicted in SEQ ID NO: 53.

The signal peptide prediction program SIGNALP (Nielsen et al. (1997) Protein Engineering 10:1-6) predicted that human TANGO 457 includes a 24 amino acid signal peptide (amino acids 1 to about amino acid 24 of SEQ ID NO: 53) (SEQ ID NO: 55) preceding the mature TANGO 457 protein (corresponding to about amino acid 25 to amino acid 365 of SEQ ID NO: 53; SEQ ID NO: 54). Human TANGO 213 is predicted to have a molecular weight of approximately 40.6 kilodaltons prior to cleavage of its signal peptide and a molecular weight of approximately 38.0 kilodaltons subsequent to cleavage of its signal peptide.

Secretion assays indicate that the polypeptide encoded by human TANGO 457 is not secreted and thus, likely a transmembrane protein. The secretion assays were performed essentially as follows: $8 \times 10^5$ 293T cells were plated per well in a 6-well plate and the cells were incubated in growth medium (DMEM, 10% fetal bovine serum, penicillin/streptomycin) at 37° C., 5% $CO_2$ overnight. 293T cells were transfected with 2 micrograms of full-length TANGO 457 inserted in the pMET7 vector/well and 10 micrograms LipofectAMINE (GIBCO/BRL Cat. # 18324-012)/well according to the protocol for GIBCO/BRL LipofectAMINE. The transfectant was removed 5 hours later and fresh growth medium was added to allow the cells to recover overnight. The medium was removed and each well was gently washed twice with DMEM without methionine and cysteine (ICN Cat. # 16-424-54). Next, 1 ml DMEM without methionine and cysteine with 50 microcuries of Trans-$^{35}$S (ICN Cat. # 51006) was added to each well and the cells were incubated at 37° C., 5% $CO_2$ for the appropriate time period. A 150 microliters aliquot of conditioned medium was obtained and 150 microliters of 2×SDS sample buffer was added to the aliquot. The sample was heat-inactivated and loaded on a 4-20% SDS-PAGE gel. The gel was fixed and the presence of secreted protein was detected by autoradiography.

Figure 5:
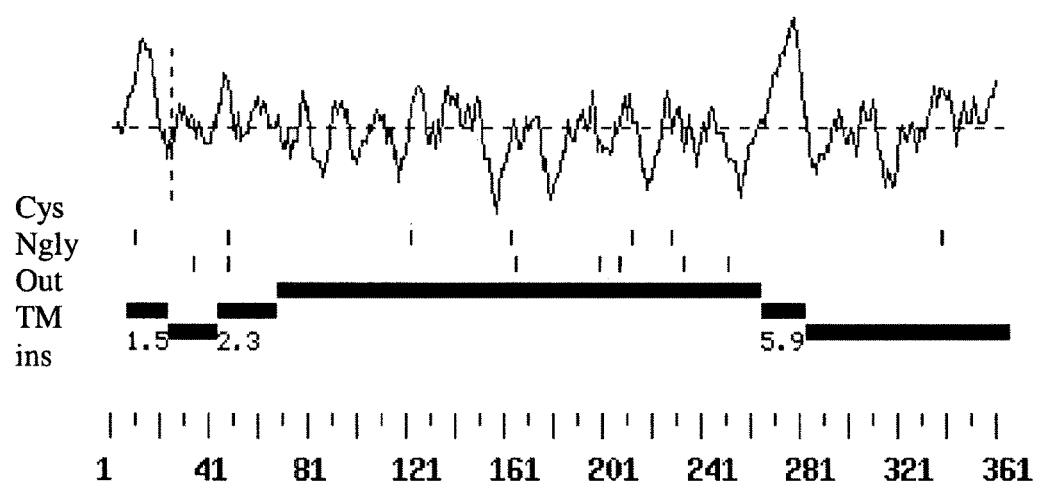
FIG. 5 depicts a hydrophobicity plot of human TANGO 457.

FIG. 5 depicts a hydrophobicity plot of the human TANGO 457 amino acid sequence shown in SEQ ID NO: 53. Relatively hydrophobic regions of the protein are shown above the horizontal line, and relatively hydrophilic regions of the protein are below the horizontal line. The cysteine residues (cys) and N-glycosylation site are indicated by short vertical lines just below the hydrophobicity trace.

In one embodiment, a TANGO 457 protein contains a cytoplasmic domain at about amino acid residues 1 to 264 of SEQ ID NO: 53 (SEQ ID NO: 56), a transmembrane domain at about amino acid residues 265 to 282 of SEQ ID NO: 53 (SEQ ID NO: 59), and an extracellular domain at about amino acid residues 283 to 365 of SEQ ID NO: 53 (SEQ ID NO: 60). In another embodiment, a human TANGO 457 protein contains an cytoplasmic domain at amino acid residues 283 to 365 of SEQ ID NO: 53 (SEQ ID NO: 60), a transmembrane domain at amino acid residues 265 to 282 of SEQ ID NO: 53 (SEQ ID NO: 59), and an extracellular domain at amino acid residues 1 to 264 of SEQ ID NO: 53 (SEQ ID NO: 56).

Human TANGO 457 includes an Ig domain at amino acids 41 to 124 and 163 to 230 of SEQ ID NO: 53, (SEQ ID NO: 57 and 8).

Seven N-glycosylation sites are present in TANGO 457. The first has the sequence NVTI (at amino acid residues 43 to 46 of SEQ ID NO: 53), the second has the sequence NITS (at amino acid residues 57 to 60 of SEQ ID NO: 53), the third has the sequence NITW (at amino acid residues 174 to 177 of SEQ ID NO: 53), the fourth has the sequence NVTS (at amino acid residues 208 to 211 of SEQ ID NO: 53), the fifth has the sequence NSSQ (at amino acid residues 216 to 219 of SEQ ID NO: 53), the sixth has the sequence NFTL (at amino acid residues 242 to 245 of SEQ ID NO: 53), and the seventh has the sequence NFSI (at amino acid residues 260 to 263 of SEQ ID NO: 53). TANGO 457 has one glycosaminoglycan attachment site with the sequence SGVG at amino acid residues 331 to 334 of SEQ ID NO: 53. Six protein kinase C phosphorylation sites are present in TANGO 457. The first has the sequence TWR (at amino acid residues 2 to 4 of SEQ ID NO: 53), the second has the sequence SLR (at amino acid residues 106 to 108 of SEQ ID NO: 53), the third has the sequence TQK (at amino acid residues 181 to 183 of SEQ ID NO: 53), the fourth has the sequence TIK (at amino acid residues 199 to 201 of SEQ ID NO: 53), the fifth has the sequence TEK (at amino acid residues 255 to 257 of SEQ ID NO: 53), and the sixth has the sequence SKK (at amino acid residues 301 to 303 of SEQ ID NO: 53). TANGO 457 has three casein kinase II phosphorylation sites. The first has the sequence TEGD (at amino acid residues 22 to 25 of SEQ ID NO: 53), the second has the sequence SSQE (at amino acid residues 217 to 220 of SEQ ID NO: 53), and the third has the sequence SLSE (at amino acid residues 251 to 254 of SEQ ID NO: 53). TANGO 457 has one tyrosine kinase phosphorylation site with the sequence KENEDKY at amino acid residues 155 to 161 of SEQ ID NO: 53. Two N-myristoylation sites are present in TANGO 457. The first has the sequence GMKENE (at amino acid residues 153 to 158 of SEQ ID NO: 53) and the second has the sequence GNVGCV (at amino acid residues 334 to 339 of SEQ ID NO: 53). Lastly, TANGO 457 has an immunoglobulin and major histocompatibility complex protein site with the sequence YQCVVRH at amino acid residues 226 to 232 of SEQ ID NO: 53.

FIG. 6A-6D depict a local alignment of the nucleic acid of human TANGO 457 shown in SEQ ID NO: 51 and a portion of the nucleotide sequence of human chromosome 11p14.3 PAC clone pDJ239b22, from nucleic acids 121077 to 122478 (SEQ ID NO: 61; AC003969). The alignment shows that there is a 100% nucleotide sequence identity between the TANGO 457 sequence of SEQ ID NO: 51 and human chromosome 11p14.3 PAC clone pDJ239b22, over the specified region. Genes known to map to the p14 region of human chromosome 11 include those encoding fetal brain protein 239 and hepatitis B virus integration site-I (see http://www.ncbi.nlm.nih.gov/htbin-post/Omim/getmap?d3076).

Expressed sequence tags (ESTs) which exhibit homology to TANGO 457 (SEQ ID NO: 51) have been isolated from a B-cell leukemia cell line and from fetal liver, fetal spleen, and placenta tissues. The dbEST accession numbers of these ESTs are AI361759, AA004711, AA004711, and AI189960, respectively. TANGO 457 (SEQ ID NO: 51) exhibits about 80% homology to AI361759 over about 445 base pairs, from nucleotides 1861 to 2306 of TANGO 457. TANGO 457 (SEQ ID NO: 51) exhibits about 77% homology to AA004711 over about 375 base pairs, from nucleotides 1830 to 2205 of TANGO 457. TANGO 457 (SEQ ID NO: 51) exhibits about 81% homology to AI189960 over about 415 base pairs, from nucleotides 1908 to 2320.

Uses of TANGO 457 Nucleic Aids, Polypeptides, and Modulators Thereof

TANGO 457 proteins are involved in disorders which affect both tissues in which they are normally expressed and tissues in which they are normally not expressed. Based on the observations that cDNA corresponding to TANGO 457 occurs in a uterine smooth muscle cDNA library, bears homology to human chromosome 11p14.3 PAC clone pDJ239b22, and bears homology to ESTs isolated from B-cell leukemia, liver, spleen, and placenta libraries, it is evident that TANGO 457 protein is involved in one or more biological processes which occur in these tissues. In particular, TANGO 457 is involved in modulating proliferation, migration, morphology, differentiation, and/or function of cells of these tissues. Relevant disorders which involve these tissues are discussed separately below.

As TANGO 457 was originally found in a uterine smooth muscle library, TANGO 457 polypeptides, nucleic acids, or modulators thereof, can be used to modulate the proliferation, migration, morphology, differentiation, and/or function of cells that form the uterus, e.g., endometrium endothelial cells and mesometrium smooth muscle cells, and thus to treat uterine disorders such as, e.g., hyperplasia of the endometrium, dysfunctional uterine bleeding (DUB), and uterine cancers (e.g., uterine leiomyomoma, uterine cellular leiomyoma, leiomyosarcoma of the uterus, malignant mixed mullerian tumor of uterus, uterine sarcoma). TANGO 457 polypeptides, nucleic acids, or modulators thereof can also be used to treat other reproductive disorders, including ovulation disorder, blockage of the fallopian tubes (e.g., due to pelvic inflammatory disease or endometriosis), disorders due to infections (e.g., toxic shock syndrome, chlamydia infection, Herpes infection, human papillomavirus infection), and ovarian disorders (e.g., ovarian endometriosis and ovarian cancers such as ovarian fibroma and ovarian teratoma).

As TANGO 457 bears homology to regions of human chromosome 11p14.3 PAC clone pDJ239b22, and since human chromosome 11p14.3 is the location to which such genes as those encoding fetal brain protein 239 and hepatitis B virus integration site-I are known to map, TANGO 457 nucleic acids, proteins, and modulators thereof can be used to modulate or treat disorders associated with hepatitis B infection (e.g., hepatitis, e.g., hepatitis B, and hepatocellular carcinomas) as well as CNS related disorders. Such CNS related disorders include but are not limited to bacterial and viral meningitis, Alzheimer's Disease, Huntington's disease, cerebral toxoplasmosis, Parkinson's disease, multiple sclerosis, brain cancers (e.g., cancers that have metastasized from other tissues (e.g., metastatic carcinoma of the brain), cancers of the supportive tissue of the brain (e.g., the glia; including cancers such as glioblastoma and astrocytoma), and cancers of other neural tissues (e.g., acoustic neuroma)), hydrocephalus, and encephalitis.

TANGO 457 is also expressed in the fetal liver, TANGO 457 nucleic acids, proteins, and modulators thereof can be used to modulate the proliferation, migration, morphology, differentiation, and/or function of cells that form the liver, e.g., hepatocytes, and thus to treat hepatic (liver) disorders, such as jaundice, hepatic failure, hereditary hyperbiliruinemias (e.g., Gilbert's syndrome, Crigler-Naijar syndromes and Dubin-Johnson and Rotor's syndromes), hepatic circulatory disorders (e.g., hepatic vein thrombosis and portal vein obstruction and thrombosis), hepatitis (e.g., chronic active hepatitis, acute viral hepatitis, and toxic and drug-induced hepatitis), hepatic adverse drug reactions such as hepatotoxicity, fibrosis, cirrhosis (e.g., alcoholic cirrhosis, biliary cirrhosis, and hemochromatosis), and hepatic neoplasms and tumors (e.g., primary carcinoma, hepatoblastoma, and angiosarcoma).

In addition, TANGO 457 is expressed in the fetal spleen. TANGO 457 nucleic acids, proteins, and modulators thereof can be used to modulate proliferation, migration, morphology, differentiation, function, or some combination of these, of cells that form the spleen, (e.g., cells of the splenic connective tissue, splenic smooth muscle cells, or endothelial cells of the splenic blood vessels) or of blood cells that are processed (e.g., regenerated, matured, or phagocytized) within the spleen, as described elsewhere in this disclosure.

As both fetal spleen and fetal liver are sites of hematopoiesis, TANGO 457 nucleic acids, proteins, and modulators thereof can also be used to modulate the proliferation, migration, morphology, differentiation, and/or function of hematopoietic cells, e.g., pluripotential stem cells (e.g., lymphoid cells and myeloid cells), and can be used to treat hematological disorders.

Hematological disorders include, but are not limited to, disorders associated with abnormal differentiation or hematopoiesis, morphology, migration, proliferation, or function of blood cells derived, for example, from myeloid multipotential cells in bone marrow, such as megakaryocytes (and ultimately platelets), monocytes, erythrocytes, and granulocytes (e.g., neutrophils, eosinophils, and basophils) and from lymphoid multipotential cells, such as T and B lymphocytes.

Platelet associated disorders include, but are not limited to, thrombocytopenia due to a reduced number of megakaryocytes in the bone marrow, for example, as a result of chemotherapy; invasive disorders, such as leukemia, idiopathic or drug- or toxin-induced aplasia of the marrow, or rare hereditary amegakaryocytic thrombocytopenias; ineffective thrombopoiesis, for example, as a result of megaloblastic anemia, alcohol toxicity, vitamin B 12 or folate deficiency, myelodysplastic disorders, or rare hereditary disorders (e.g., Wiskott-Aldrich syndrome and May-hegglin anomaly); a reduction in platelet distribution, for example, as a result of cirrhosis, a splenic invasive disease (e.g., Gaucher's disease), or myelofibrosis with extramedullary myeloid metaplasia; increased platelet destruction, for example, as a result of removal of IgG-coated platelets by the mononuclear phagocytic system (e.g., idiopathic thrombocytopenic purpura (ITP), secondary immune thrombocytopenia (e.g., systemic lupus erythematosus, lymphoma, or chronic lymphocytic leukemia), drug-related immune thrombocytopenias (e.g., as with quinidine, aspirin, and heparin), post-transfusion purpura, and neonatal thrombocytopenia as a result of maternal platelet autoantibodies or maternal platelet alloantibodies). Also included are thrombocytopenia secondary to intravascular clotting and thrombin induced damage to platelets as a result of, for example, obstetric complications, metastatic tumors, severe gram-negative bacteremia, thrombotic thrombocytopenic purpura, or severe illness. Also included is dilutional thrombocytopenia, for example, due to massive hemorrhage. Platelet associated disorders also include, but are not limited to, essential thrombocytosis and thrombocytosis associated with, for example, splenectomy, acute or chronic inflammatory diseases, hemolytic anemia, carcinoma, Hodgkin's disease, lymphoproliferative disorders, and malignant lymphomas.

Erythrocyte associated disorders include anemias such as, for example, hemolytic anemias due to hereditary cell membrane abnormalities, such as hereditary spherocytosis, hereditary elliptocytosis, and hereditary pyropoikilocytosis; hemolytic anemias due to acquired cell membrane defects, such as paroxysmal nocturnal hemoglobinuria and spur cell anemia; hemolytic anemias caused by antibody reactions, for example to the RBC antigens, or antigens of the ABO system, Lewis system, Ii system, Rh system, Kidd system, Duffy system, and Kell system; methemoglobinemia; a failure of erythropoiesis, for example, as a result of aplastic anemia, pure red cell aplasia, myelodysplastic syndromes, sideroblastic anemias, and congenital dyserythropoietic anemia; secondary anemia in non-hematolic disorders, for example, as a result of chemotherapy, alcoholism, or liver disease; anemia of chronic disease, such as chronic renal failure; and endocrine deficiency diseases.

Other erythrocyte associated disorders include polycythemias such as, for example, polycythemia vera, secondary polycythemia, and relative polycythemia.

Neutrophil associated disorders include neutropenias that result from or accompany a number of conditions, including, but not limited to, chemotherapy; chronic idiopathic neutropenia; Felty's syndrome, acute infectious disease, lymphoma or aleukemic lymphocytic leukemia, myelodysplastic syndrome, and rheumatic diseases such as systemic lupus erythematosus, rheumatoid arthritis, and polymyositis. Also included is neutrophilia, for example, accompanying chronic myelogenous leukemia.

Other hematological disorders include disorders associated with abnormal monocyte and/or macrophage function, such as impaired phagocytosis, chemotaxis, or secretion of cytokines, growth factors and acute-phase reactants, resulting from certain diseases, e.g., lysosomal storage diseases (e.g., Gaucher's disease); impaired monocyte cytokine production, for example, found in some patients with disseminated non-tuberculous mycobacterial infection who are not infected with HIV; leukocyte adhesion deficiency (LAD), hyperimmunoglobulin E-recurrent infection (HIE) or Job's syndrome, Chédiak-Higashi syndrome (CHS), and chronic granulomatous diseases (CGD), certain autoimmune diseases, such as systemic lupus erythematosus and other autoimmune diseases characterized by tissue deposition of immune complexes, as seen in Sjogren's syndrome, mixed cryoglobulinemia, dermatitis herpetiformis, and chronic progressive multiple sclerosis. Also included are disorders or infections that impair mononuclear phagocyte function, for example, influenza virus infection and AIDS.

Monocyte associated disorders include monocytoses such as, for example, monocytoses associated with certain infections such as tuberculosis, brucellosis, subacute bacterial endocarditis, Rocky Mountain spotted fever, malaria, and visceral leishmaniasis (kala azar), in malignancies, leukemias, myeloproliferative syndromes, hemolytic anemias, chronic idiopathic neutropenias, and granulomatous diseases such as sarcoidosis, regional enteritis, and some collagen vascular diseases.

Other monocyte associated disorders include monocytopenias such as, for example, monocytopenias that can occur with acute infections, with stress, following administration of glucocorticoids, aplastic anemia, hairy cell leukemia, and acute myelogenous leukemia and as a direct result of administration of myelotoxic and immunosuppressive drugs.

Eosinophil associated disorders include eosinphilias such as, for example, eosinphilias that result from or accompany conditions such as allergic disorders, infections caused by parasites and other organisms, dermatologic diseases, pulmonary diseases, collagen vascular disease, neoplasms, immunodeficiency diseases, gastroenteritis, inflammatory bowel disease, chronic active hepatitis, pancreatitis, and hypopituitarism. Also included are hypereosinophilic syndrome (HES) and chronic and acute eosinophilic leukemias.

Other eosinophil associated disorders include eosinopenias such as, for example, eosinopenias that occur with stress, such as acute bacterial infection, and following administration of glucocorticoids.

Basophil associated disorders include basophilias such as, for example, basophilias seen in myeloproliferative disorders (e.g., chronic myeloid leukemia, polycythemia vera, and myeloid metaplasia), following splenectomy, hemolytic anemia, ulcerative colitis, varicella infection, and Hodgkin's disease.

As TANGO 457 is expressed in the placenta, TANGO 457 nucleic acids, proteins, and modulators thereof can be used to modulate the proliferation, migration, morphology, differentiation, and/or function of cells that form the placenta, e.g., the decidual cells (which arise during pregnancy), and thus can be used to treat placental disorders, such as toxemia of pregnancy (e.g., preeclampsia and eclampsia), placentitis, or spontaneous abortion.

As TANGO 457 is expressed in B-cell, chronic lymphotic leukemia, TANGO 457 nucleic acids, proteins, and modulators thereof can be used to modulate the proliferation, migration, morphology, differentiation, and/or function of immune cells, e.g. B-cells, dendritic cells, natural killer cells and monocytes. TANGO 457 nucleic acids, proteins and modulators thereof can also be utilized to modulate immunoglobulins and formation of antibodies, and immune-related processes, e.g., the host immune response.

Such TANGO 457 compositions and modulators thereof can be utilized modulate or treat immune disorders that include, but are not limited to, immune proliferative disorders (e.g., carcinoma, lymphoma, e.g., follicular lymphoma), disorders associated with fighting pathogenic infections (e.g., bacterial, such as chlamydial, infection, parasitic infection, and viral infections such as HSV or HIV infections), pathogenic disorders associated with immune disorders (e.g., immunodeficiency disorders, such as HIV), autoimmune disorders (e.g., rheumatoid and juvenile arthritis, rheumatism, systemic lupus erythamatosus, graft or allograft rejection, multiple sclerosis, Grave's disease, and Hashimoto's disease), immunodeficiency disorders (e.g., B and T cell immunodeficiency disorders and AIDS), bacterial, viral, and parasitic infections (e.g., sepsis, influenza, common colds, hepatitis, HIV infection, malaria, and gonorrhea), disorders associated with undesirable immune reactions with foreign material (e.g., transplant rejection, environmental {e.g., latex} hypersensitivity disorders, and allergic disorders), phagocytic dysfunction disorders (e.g., neutropenia and chronic granulomatous disease), anaphylaxis, urticaria, and inflammatory disorders (e.g., septicemia, cerebral malaria, inflammatory bowel disease, arthritis such as rheumatoid arthritis and osteoarthritis, allergic inflammatory disorders such as asthma and psoriasis, apoptotic disorders such as rheumatoid arthritis, systemic lupus erythematosus, and insulin-dependent diabetes mellitus, cytotoxic disorders, septic shock, and cachexia).

As TANGO 457 contains one or more Ig domains, and as immunoglobulin superfamily proteins are cell surface molecules involved in signal transduction and cellular proliferation, TANGO 457 nucleic acids, proteins and modulators thereof can be utilized to modulate the development and progression of cancerous and non-cancerous cell proliferative disorders, such as deregulated proliferation (such as hyperdysplasia, hyper-IgM syndrome, or lymphoproliferative disorders), cirrhosis of the liver (a condition in which scarring has overtaken normal liver regeneration processes), treatment of keloid (hypertrophic scar) formation (disfiguring of the skin in which the scarring process interferes with normal renewal), psoriasis (a common skin condition characterized by excessive proliferation of the skin and delay in proper cell fate determination), benign tumors, fibrocystic conditions, and tissue hypertrophy (e.g., prostatic hyperplasia), cancers such as neoplasms or tumors (such as carcinomas, sarcomas, adenomas or myeloid lymphoma tumors, e.g., fibrosarcoma, myxosarcoma, liposarcoma, chondrosarcoma, osteogenic sarcoma, chordoma, angiosarcoma, endotheliosarcoma, lymphangiosarcoma, lymphangioendotheliosarcoma, synovioma, mesothelioma, Ewing's tumor, leimyosarcoma, rhabdotheliosarcoma, colon sarcoma, pancreatic cancer, breast cancer, ovarian cancer, prostate cancer, squamous cell carcinoma, basal cell carcinoma, adenocarcinoma, sweat gland carcinoma, sebaceous gland carcinoma, papillary carcinoma, papillary adenocarcinomas, cystadenocarcinoma, medullary carcinoma, bronchogenic carcinoma, renal cell carcinoma, hematoma, bile duct carcinoma, melanoma, choriocarcinoma, semicoma, embryonal carcinoma, Wilms' tumor, cervical cancer, testicular tumor, lung carcinoma, small cell carcinoma, bladder carcinoma, epithelial carcinoma, glioma, astrocytoma, medulloblastoma, craniopharyngioma, ependynoma, pinealoma, hemangioblastoma, retinoblastoma), leukemias, (e.g. acute lymphocytic leukemia), acute myelocytic leukemia (myelolastic, promyelocytic, myelomonocytic, monocytic and erythroleukemia), chronic leukemias (chronic myelocytic (granulocytic) leukemia and chronic lymphocytic leukemia), or polycythemia vera, or lymphomas (Hodgkin's disease and non-Hodgkin's diseases), multiple myelomas and Waldenstrom's macroglobulinemia.

TANGO 229

A cDNA clone (designated jthtc001c06) encoding at least a portion of human TANGO 229 protein was isolated from a human T cell cDNA library. Human TANGO 229 protein is a transmembrane protein.

The full length of the cDNA encoding human TANGO 229 protein (SEQ ID NO: 71) is 3594 nucleotide residues. The open reading frame (ORF) of this cDNA, nucleotide residues 72 to 2216 of SEQ ID NO: 71 (i.e., SEQ ID NO: 72), encodes a 715-amino acid residue protein (SEQ ID NO: 73), corresponding to a 681-residue transmembrane mature protein.

The invention thus includes purified human TANGO 229 protein, both in the form of the immature 715 amino acid residue protein (SEQ ID NO: 73) and in the form of the mature 681 amino acid residue protein (SEQ ID NO: 75). Mature human TANGO 229 proteins can be synthesized without the signal sequence polypeptide at the amino terminus thereof, or they can be synthesized by generating immature TANGO 229 protein and cleaving the signal sequence therefrom.

The invention includes nucleic acid molecules which encode a polypeptide of the invention. Such nucleic acids include, for example, a DNA molecule having the nucleotide sequence listed in SEQ ID NO: 71, such as the portion which encodes mature TANGO 229 protein, immature TANGO 229 protein, or a domain of TANGO 229 protein. These nucleic acids are collectively referred to as nucleic acids of the invention.

TANGO 229 proteins and nucleic acid molecules encoding them comprise a family of molecules having certain conserved structural and functional features.

A common domain present in TANGO 229 proteins is a signal sequence. In one embodiment, a TANGO 229 protein contains a signal sequence corresponding to amino acid residues 1 to 34 of SEQ ID NO: 73 (SEQ ID NO: 74). It is recognized that the carboxyl terminal boundary of the signal sequence can be located one or two residues from the residue identified above (i.e., following residues 32, 33, 34, 35, or 36 of SEQ ID NO: 73). The signal sequence is cleaved during processing of the mature protein.

TANGO 229 proteins include a transmembrane domain and two extra-membrane domains flanking the cell membrane. The transmembrane domain corresponds to about amino acid residues 456 to 480 of SEQ ID NO: 73 (i.e., the transmembrane domain having the sequence SEQ ID NO: 77). One of the extra-membrane domains corresponds to about amino acid residues 35 to 455 of SEQ ID NO: 73. This domain has the sequence SEQ ID NO: 76, and is most likely an extracellular domain. The other extra-membrane domain corresponds to about amino acid residues 481 to 715 of SEQ ID NO: 73. This domain has the sequence SEQ ID NO: 78, and is most likely a cytoplasmic domain. In one embodiment, the domain corresponding to about amino acid residues 35 to 455 of SEQ ID NO: 73 is a cytoplasmic domain, and the domain corresponding to about amino acid residues 481 to 715 is an extracellular domain.

TANGO 229 proteins typically comprise a variety of potential post-translational modification sites and protein domains (often positioned within an extracellular domain), such as those described herein in Table II, as predicted by computerized sequence analysis of TANGO 229 proteins using amino acid sequence comparison software (comparing the amino acid sequence of TANGO 229 with the information in the PROSITE database {rel. 12.2; February 1995} and the Hidden Markov Models database {Rel. PFAM 3.3}).

TABLE II

| Type of Potential Modification Site or Domain | Amino Acid Residues of SEQ ID NO: 73 | Amino Acid Sequence |
|---|---|---|
| N-glycosylation site | 64 to 67 | NHTV |
|  | 124 to 127 | NTSE |
|  | 277 to 280 | NESG |
|  | 351 to 354 | NNSK |
|  | 418 to 421 | NDSL |
|  | 455 to 458 | NITT |
|  | 707 to 710 | NQTA |
| cAMP/cGMP-dependent protein kinase phosphorylation site | 322 to 325 | KKIT |
|  | 424 to 427 | RKTS |
|  | 485 to 488 | KKGS |
|  | 553 to 556 | RKGS |
| Protein kinase C phosphorylation site | 54 to 56 | TSK |
|  | 129 to 131 | TVR |
|  | 139 to 141 | SGR |
|  | 244 to 246 | SDK |
|  | 357 to 359 | TYK |
|  | 433 to 435 | STK |
|  | 527 to 529 | TQK |
|  | 552 to 554 | TRK |
|  | 557 to 559 | TFR |
|  | 683 to 685 | SQK |
| Casein kinase II phosphorylation site | 46 to 49 | TYQD |
|  | 66 to 69 | TVCE |
|  | 103 to 106 | SSSD |
|  | 157 to 160 | TCLE |
|  | 226 to 229 | SRYE |
|  | 242 to 245 | SLSD |
|  | 275 to 278 | SVNE |
|  | 434 to 437 | TKKE |
|  | 563 to 566 | TDAE |
| N-myristoylation site | 4 to 9 | GARGGG |
|  | 51 to 56 | GTMTSK |
|  | 60 to 65 | GTYPNH |
|  | 135 to 140 | GSHISG |
|  | 214 to 219 | GGQISV |
|  | 230 to 235 | GILANG |
|  | 254 to 259 | GCSRSL |
|  | 265 to 270 | GQIRAS |

TABLE II-continued

| Type of Potential Modification Site or Domain | Amino Acid Residues of SEQ ID NO: 73 | Amino Acid Sequence |
|---|---|---|
|  | 326 to 331 | GIRTTG |
|  | 360 to 365 | GIVNNE |
|  | 411 to 416 | GCQITQ |
|  | 453 to 458 | GINITT |
|  | 475 to 480 | GIFAAF |
|  | 487 to 492 | GSPYGS |
|  | 646 to 651 | GAQDGD |
|  | 691 to 696 | GTSDSY |
| Amidation site | 76 to 79 | KGKR |
| CUB domain | 41 to 147 |  |
| Factor V/VIII discoidin domain | 258 to 409 |  |

In various embodiments, the protein of the invention has at least 1, 2, 4, 6, 10, 15, or 20 or more of the post-translational modification sites described herein in Table II.

Examples of additional domains present in human TANGO 229 protein include a CUB domain and a Factor V/VIII discoidin domain. In one embodiment, the protein of the invention has at least one domain or signature sequence that is at least 55%, preferably at least about 65%, 75%, 85%, or 95% identical to one of the domains or signature sequences described herein in Table II. Preferably, the protein of the invention has at least one CUB domain and one Factor V/VIII discoidin domain.

CUB domains are extracellular domains of about 110 amino acid residues which occur in functionally diverse, mostly developmentally regulated proteins (Bork and Beckmann (1993) J. Mol. Biol. 231:539-545; Bork (1991) FEBS Lett. 282:9-12). Many CUB domains contain four conserved cysteine residues, although some, like that of TANGO 202, contain only two of the conserved cysteine residues. The structure of the CUB domain has been predicted to assume a beta-barrel configuration, similar to that of immunoglobulins. Other proteins which comprise one or more CUB domains include, for example, mammalian complement sub-components Cls and Clr, hamster serine protease Casp, mammalian complement activating component of Ra-reactive factor, vertebrate enteropeptidase, vertebrate bone morphogenic protein 1, sea urchin blastula proteins BP 10 and SpAN, *Caenorhabditis elegans* hypothetical proteins F42A10.8 and R151.5, neuropilin (A5 antigen, in which a pair of Factor V/VIII discoidin domains also occur), sea urchin fibropellins I and III, mammalian hyaluronate-binding protein TSG-6 (PS4), mammalian spermadhesins, and Xenopus embryonic protein UVS.2. The presence of a CUB domain in TANGO 229 protein indicates that TANGO 229 is involved in one or more physiological processes in which these other CUB domain-containing proteins are involved, has a biological activity in common with one or more of these other CUB domain-containing proteins, or both. The presence of a CUB domain in TANGO 229 protein also indicates that TANGO 229 can be developmentally regulated.

Factor V/VIII discoidin domains are involved in binding with cell surface-attached carbohydrates. These domains occur in a variety of intracellular, extracellular, and transmembrane proteins, including human and murine coagulation factor V, human and murine coagulation factor VIII precursor, human and murine neuropilins, a variety of receptor-like tyrosine kinases (e.g., neurotrophic tyrosine kinases and cell adhesion tyrosine kinases), carboxypeptidases and carboxypeptidase-like proteins, milk fat globule glycoproteins, human breast epithelial antigen BA46, murine neurexin IV, human X-linked juvenile retinoschisis precursor protein, and human contactin associated protein. Presence of a Factor V/VIII discoidin domain in TANGO 229 indicates that this protein is involved in one or more physiological processes in which these other Factor V/VIII discoidin domain-containing proteins are involved, has biological activity in common with one or more of these other Factor V/VIII discoidin domain-containing proteins, or both. Presence of a Factor V/VIII discoidin domain in TANGO 229 protein is an indication that TANGO 229 is associated with binding of one or more glycosylated proteins at the surface of cells which express TANGO 229. Binding of glycosylated proteins at the cell surface is associated with several physiologically relevant phenomena, including cell adhesion (including cell repulsion), transmembrane signal transduction, and nutrient binding and uptake by cells. The Factor V/VIII discoidin domain of human coagulation factor VIII protein is known to be involved in binding of factor VIII with von Willebrand factor and with membrane-associated lipids such as phosphatidylserine. Presence of a Factor V/VIII discoidin domain in TANGO 229 protein is thus an indication that the extracellular portion of TANGO 229 protein can interact with membrane lipids.

The signal peptide prediction program SIGNALP (Nielsen et al. (1997) Protein Engineering 10:1-6) predicted that human TANGO 229 protein includes a 34 amino acid residue signal peptide (amino acid residues 1 to 34 of SEQ ID NO: 73; SEQ ID NO: 74) preceding the mature TANGO 229 protein (amino acid residues 35 to 715 of SEQ ID NO: 73; SEQ ID NO: 75). Human TANGO 229 protein includes an extracellular domain (amino acid residues 35 to 455 of SEQ ID NO: 73; SEQ ID NO: 76), a transmembrane domain (amino acid residues 456 to 480 of SEQ ID NO: 73; SEQ ID NO: 77), and an intracellular domain (amino acid residues 481 to 715 of SEQ ID NO: 73; SEQ ID NO: 78). In an alternative embodiment, amino acid residues 35 to 455 of SEQ ID NO: 73 correspond to an intracellular domain of human TANGO 229 protein and residues 481 to 715 correspond to an extracellular domain.

Figure 7:
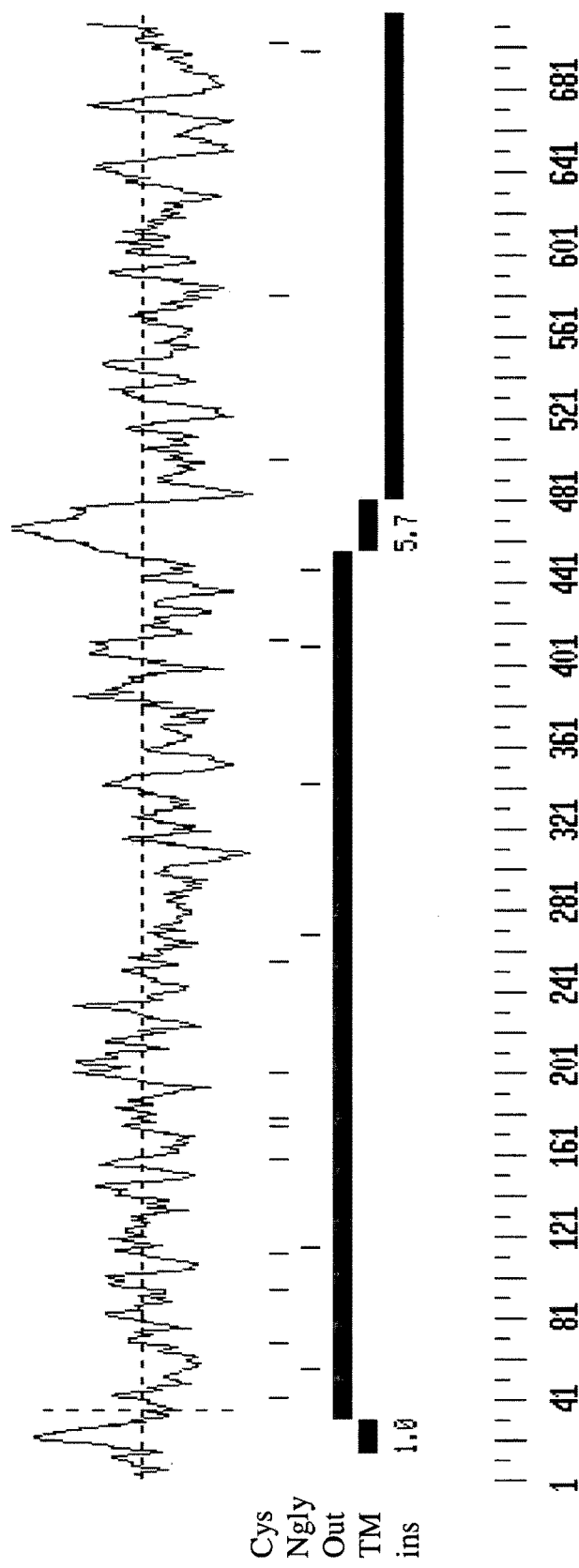
FIG. 7 is a hydrophobicity plot of one embodiment of human TANGO 229 protein.
Figure 10A:
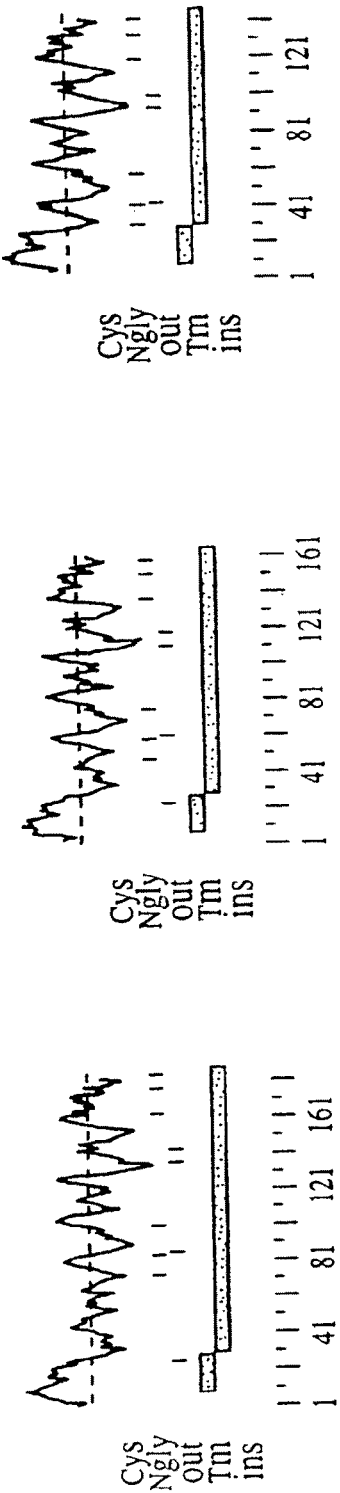
FIGS. 10A-10F is a series of hydrophobicity plots for individual forms of human INTERCEPT 289 protein. The plot corresponding to form 1a is shown in FIG. 10A. The plot corresponding to form 1b is shown in FIG. 10B. The plot corresponding to form 2a is shown in FIG. 10C. The plot corresponding to form 2b is shown in FIG. 10D. The plot corresponding to form 3a is shown in FIG. 10E. The plot corresponding to form 3b is shown in FIG. 10F.
Figure 10B:
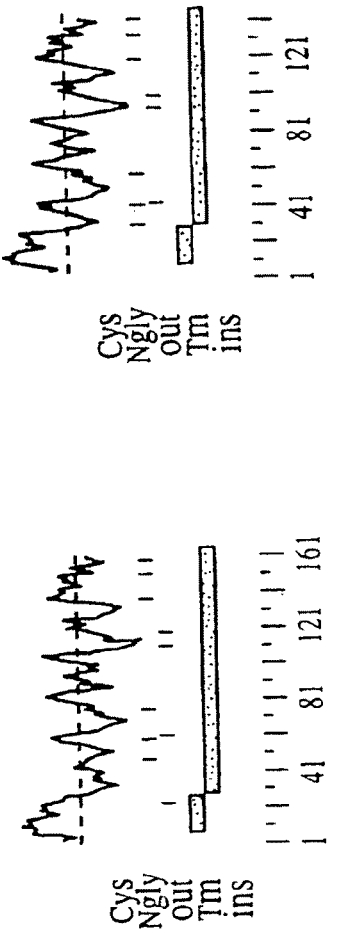
Figure 10C:
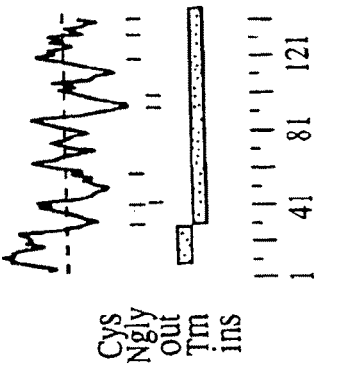
Figure 10D:
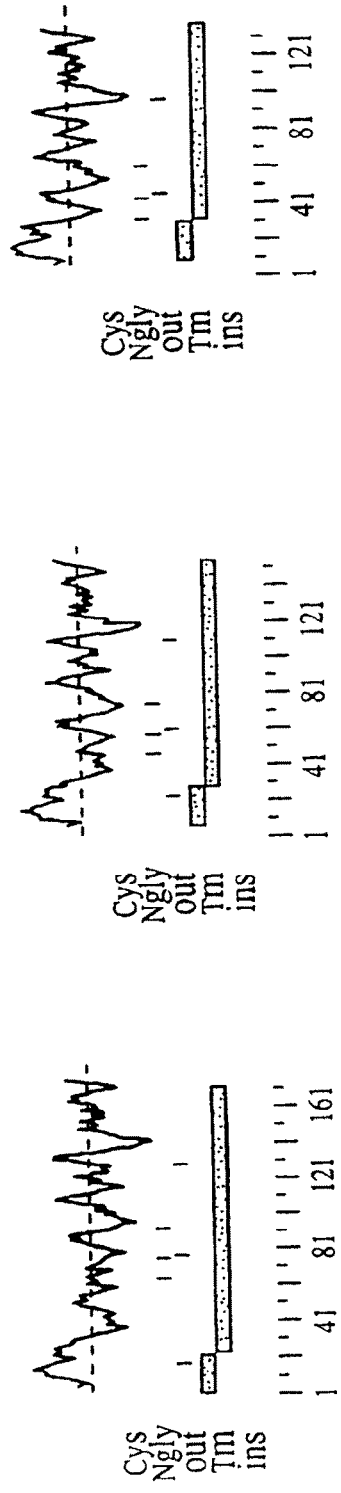
Figure 10E:
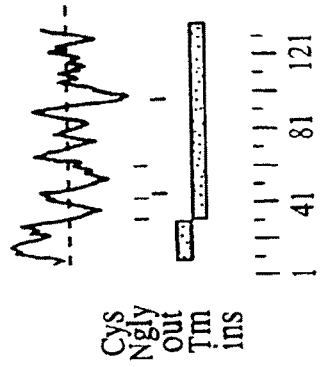
Figure 10F:

FIG. 7 depicts a hydrophobicity plot of human TANGO 229 protein. Relatively hydrophobic regions are above the dashed horizontal line, and relatively hydrophilic regions are below the dashed horizontal line. The hydrophobic region which corresponds to amino acid residues 1 to 34 of SEQ ID NO: 73 is the signal sequence of human TANGO 229 (SEQ ID NO: 74). As described elsewhere herein, relatively hydrophilic regions are generally located at or near the surface of a protein, and are more frequently effective immunogenic epitopes than are relatively hydrophobic regions. For example, the region of human TANGO 229 protein from about amino acid residue 50 to about amino acid residue 70 appears to be located at or near the surface of the protein, while the region from about amino acid residue 195 to about amino acid residue 210 appears not to be located at or near the surface.

The predicted molecular weight of human TANGO 229 protein without modification and prior to cleavage of the signal sequence is about 77.9 kilodaltons. The predicted molecular weight of the mature human TANGO 229 protein without modification and after cleavage of the signal sequence is about 72.3 kilodaltons.

Northern hybridization experiments using human tissue samples indicated that mRNA corresponding to cDNA encoding TANGO 229 is expressed in the tissues listed in Table IIIA, wherein "++" indicates strongly detectable expression, "+" indicates a lesser degree of expression, and "+/–" indicates a still lesser degree of expression. In these tissues, two alternatively spliced forms of cDNA encoding TANGO 229 (having sizes of about 2.0 and 4.0 kilobases) were detected.

TABLE IIIA

| Tissue | Expression |
| --- | --- |
| Heart | ++ |
| Liver | ++ |
| Pancreas | ++ |
| Placenta | + |
| Brain | +/– |
| Lung | +/– |
| Skeletal Muscle | +/– |
| Kidney | +/– |

Northern hybridization experiments using human immune system tissue samples indicated that mRNA corresponding to the cDNA encoding TANGO 229 is expressed in the tissues listed in Table IIIB. In these tissues, two alternatively spliced forms of cDNA encoding TANGO 229 (having sizes of about 2.0 and 4.9 kilobases) were detected.

TABLE IIIB

| Tissue | Expression |
| --- | --- |
| Spleen | ++ |
| Lymph node | ++ |
| Fetal Liver | ++ |
| Peripheral blood leukocytes | + |
| Bone Marrow | + |
| Thymus | +/– |

The nucleotide sequence (SEQ ID NO: 71) of TANGO 229 cDNA was aligned (using the LALIGN software {Huang and Miller (1991) Adv. Appl. Math. 12:373-381}; pam120 scoring matrix, gap opening penalty=12, gap extension penalty=4) with the nucleotide sequence of the portion of human chromosome region 6q21 listed in GenBank Accession No. Z85999. This alignment indicated 45.8% identity between the two sequences in the 3826-residue overlapping portion.

The nucleotide sequence (SEQ ID NO: 71) of TANGO 229 cDNA was also aligned (using the LALIGN software; pam120 scoring matrix, gap opening penalty=12, gap extension penalty=4) with an expressed sequence tag (EST) clone designated BP481 in P.C.T. Publication No. WO98/45435. This alignment indicated 72.9% identity between the two sequences in the 414-residue overlapping portion.

Uses of TANGO 229 Nucleic Acids, Polypeptides, and Modulators Thereof

TANGO 229 proteins are involved in disorders which affect both tissues in which they are normally expressed and tissues in which they are normally not expressed. Based on the observations that cDNA corresponding to TANGO 229 occurs in a human T cell cDNA library, and that RNA corresponding to TANGO 229 is detectable by Northern analysis of human heart, liver, pancreas, placenta, brain lung, skeletal muscle, kidney, spleen, lymph node, peripheral blood leukocyte, bone marrow, and thymus tissues, it is evident that TANGO 229 protein can be involved in one or more biological processes which occur in these tissues. In particular, TANGO 229 can be involved in modulating growth, proliferation, survival, differentiation, and activity of cells of these tissues (e.g., T cells and other cells of the immune system).

Expression of TANGO 229 in a variety of immune system tissues (e.g., T cells, peripheral blood leukocyte, and spleen, lymph node, bone marrow, and thymus tissues) is an indication that TANGO 229 can have a role in both normal immune processes and in a variety of disorders which affect or involve the immune system, such as the immune disorders described elsewhere in this disclosure.

The presence of a factor V/VIII discoidin domain in TANGO 229 protein is an indication that the protein can be involved in mediating cell binding and adhesion, including binding/adhesion of cells with other cells, with extracellular matrix, and with foreign materials (i.e., materials not originating in the body of the same individual). Cell binding and adhesion affected by TANGO 229 can encompass interactions between cells and between cells and extracellular components, which interactions lend structural and mechanical support to body tissues and containment of body fluids (e.g., by blood coagulation). However, TANGO 229 can also regulate cell-to-cell and cell-to-environment interactions which have little relevance to the structural integrity of the animal, but which permit information exchange between cells (e.g., cell-to-cell signaling such as that which occurs between helper T cells and antibody-producing B cells) or between cells and the environment (e.g., recognition by cells of the presence of a particular chemical entity, such as an antigen, in the environment). Certain cell-to-environment interactions mediated by TANGO 229 can also permit a cell which expresses it to exert an effect upon (e.g., degrade, absorb, or envelop) a component of the environment.

Involvement of TANGO 229 protein in binding of cells is an indication that TANGO 229 can be involved in disorders associated with aberrant binding or adhesion of cells with other cells, with extracellular matrix, or with foreign materials. Disorders involving aberrant binding or adhesion of cells with other cells include both disorders in which cells normally bind with one another (e.g., metastasis of normally solid tumor tissue cells away from the tumor site of origin or immune hypersensitivity) and disorders in which the cells do not normally bind with one another, but do bind with one another in individuals afflicted with the disorder (e.g., metastasis of tumor cells into a tissue in which the cells do not normally occur, autoimmune disorders, infections, wherein cells with which T cells bind are not normally present in the animal, or disorders associated with abnormal blood coagulation). Disorders involving aberrant binding or adhesion of cells with extracellular matrix include those (e.g., metastasis of cancerous cells through or into extracellular matrix and away from the normal body location of the cells) in which the cells normally do, but aberrantly do not, bind with extracellular matrix as well as those (e.g., metastasis of cancers cells into extracellular matrix at body locations at which they do not normally occur, autoimmune disorders, liver fibrosis, abnormal blood coagulation, atherosclerosis, and arteriosclerosis) in which the cells normally do not bind with extracellular matrix, but aberrantly do. Examples of disorders involving aberrant binding or adhesion of cells with foreign materials include those (e.g., allergies and hypersensitivity disorders such as latex hypersensitivity) associated with aberrant binding with the foreign material and disorders in which the cells normally bind with the foreign material, but aberrantly do not. TANGO 229 proteins, nucleic acids encoding them, and agents that modulate activity or expression of either of these can be used to prognosticate, diagnose, and treat one or more of these disorders.

Like certain known developmental proteins (e.g., human neuropilins; Kolodkin and Ginty (1997) Neuron 19:1159-1162), TANGO 229 protein contains both a CUB domain and a factor V/VIII discoidin domain. The presence of both of these types of domains is an indication that TANGO 229 protein is involved in mediating attraction and repulsion of cells and translocation of cells through, past, or along other cells or tissues. For example, TANGO 229 can, alone or in conjunction with one or more neuropilins, bind with a semaphorin protein to direct nerve growth.

Apart from regulating the rate and direction of nerve growth, TANGO 229 can regulate the rate and direction of growth of other tissues, such as vascular tissues (e.g., during angiogenesis). TANGO 229 can also modulate the direction and rate of cell movement, relative to another cell or relative to a tissue, such as movement of leukocytes through vascular lumenal epithelium (e.g., during leukocytic extravasation) or movement of metastatic cells through a solid tissue. Another example of such modulation is the effect that TANGO 229 can have on the rate of cell growth, depending on contact between two cells or between two tissues. TANGO 229 can regulate cell growth such that the growth slows or substantially stops when two tissues contact one another (e.g., during wound healing). TANGO 229 is thus involved in disorders associated with aberrant growth or movement of cells through, past, or along other cells or tissues. Examples of disorders of these types include cancerous growth and proliferation of cells, metastasis of cancerous cells (i.e., including metastasis away from the normal body location of the cells, through tissues and extracellular matrix, and into body locations at which the cells do not normally occur), inflammation, atherosclerosis, arteriosclerosis, abnormal blood coagulation, asthma, and chronic obstructive pulmonary disorders. TANGO 229 proteins, nucleic acids encoding them, and agents that modulate activity or expression of either of these can be used to prognosticate, diagnose, and treat one or more of these disorders.

Like many transmembrane signaling proteins, TANGO 229 protein comprises extracellular domains capable of interacting with environmental cues (e.g., the presence or absence of particular cells, proteins, or small molecules) and a cytoplasmic domain having a substantial size. For example, several tyrosine-protein kinases (e.g., human and murine cell adhesion kinase and neurotrophic receptor-related tyrosine kinase-3) comprise one or more factor V/VIII discoidin domains. The structure of TANGO 229 protein, which has several potential phosphorylation sites, is thus an indication that the protein can be involved in transducing signals across the cell membrane. Binding of a ligand of TANGO 229 protein with a portion of the protein located on one side of the membrane can affect one or more characteristics (e.g., conformation, phosphorylation state, or level or specificity of enzymatic activity) of a portion of the protein located on the other side. Thus, for example, a compound in the extracellular environment of a cell which expresses TANGO 229 can bind with the extracellular domain of the protein, thereby effecting a change in a characteristic of the intracellular portion of the protein, leading to alteration of the physiology of the cell (e.g., effected by an activity exerted by the intracellular portion of the protein on another component of the cell). The compound in the extracellular environment can, for example, be a compound dissolved or suspended in a liquid, a compound attached to another cell of the same animal, or a compound attached to a foreign cell or virus particle. TANGO 229 protein can associate with other signal transduction proteins in the cell membrane, thereby modulating the intracellular activity of those other proteins. TANGO 229 protein can thus have a role in disorders which involve aberrant transmembrane signal transduction. Examples of signal transduction-related disorders include cystic fibrosis, various chronic obstructive pulmonary disorders, inflammation, aberrant or undesirable angiogenesis, and obesity. TANGO 229 proteins, nucleic acids encoding them, and agents that modulate activity or expression of either of these can be used to prognosticate, diagnose, and treat one or more of these disorders.

INTERCEPT 289

A cDNA clone (designated jthLa186d06) encoding at least a portion of human INTERCEPT 289 protein was isolated from a human mixed lymphocyte reaction cDNA library. Human INTERCEPT 289 protein is a transmembrane protein which can occur in at least six alternative forms. These forms are herein designated "form 1a," "form 1b," "form 2a," "form 2b," "form 3a," and "form 3b" for convenience. The properties of and variations among these forms are described herein.

1a) The full length of the cDNA encoding INTERCEPT 289 protein form 1a (SEQ ID NO: 81) is 4074 nucleotide residues. The ORF of this cDNA, nucleotide residues 179 to 742 of SEQ ID NO: 81 (i.e., SEQ ID NO: 82), encodes a 188-amino acid residue protein having the amino acid sequence SEQ ID NO: 83.

1b) The full length of the cDNA encoding INTERCEPT 289 protein form 1b (SEQ ID NO: 91) is 4018 nucleotide residues. The ORF of this cDNA, nucleotide residues 179 to 712 of SEQ ID NO: 91 (i.e., SEQ ID NO: 92), encodes a 178-amino acid residue protein having the amino acid sequence SEQ ID NO: 93.

2a) The full length of the cDNA encoding INTERCEPT 289 protein form 2a (SEQ ID NO: 96) is 3985 nucleotide residues. The ORF of this cDNA, nucleotide residues 162 to 656 of SEQ ID NO: 96 (i.e.; SEQ ID NO: 97), encodes a 165-amino acid residue protein having the amino acid sequence SEQ ID NO: 98.

2b) The full length of the cDNA encoding INTERCEPT 289 protein form 2b (SEQ ID NO: 101) is 3958 nucleotide residues. The ORF of this cDNA, nucleotide residues 162 to 626 of SEQ ID NO: 101 (i.e., SEQ ID NO: 102), encodes a 155-amino acid residue protein having the amino acid sequence SEQ ID NO: 103.

3a) The full length of the cDNA encoding INTERCEPT 289 protein form 3a (SEQ ID NO: 106) is 3925 nucleotide residues. The ORF of this cDNA, nucleotide residues 162 to 596 of SEQ ID NO: 106 (i.e., SEQ ID NO: 107), encodes a 145-amino acid residue protein having the amino acid sequence SEQ ID NO: 108.

3b) The full length of the cDNA encoding INTERCEPT 289 protein form 3b (SEQ ID NO: 111) is 3898 nucleotide residues. The ORF of this cDNA, nucleotide residues 162 to 566 of SEQ ID NO: 111 (i.e., SEQ ID NO: 112), encodes a 135-amino acid residue protein having the amino acid sequence SEQ ID NO: 113.

The mixed lymphocyte reaction library from which the cDNAs encoding INTERCEPT 289 were isolated was prepared as follows. Mononuclear cells were isolated from 50 milliliters of peripheral blood pooled from 22 human donors. Mononuclear cells were isolated using HISTOPAQUE™ 1077 (Sigma Chemical Co., St. Louis, Mo.) according to the manufacturer's instructions and collected in heparinized tubes. After pooling the mononuclear cells, CD19+ B cells were removed by positive selection using MACS™ beads and a VS+ separation column (Miltenyi Biotec, Germany) according to the manufacturer's instructions. CD19−cells were re-suspended at an approximate density of $10 \times 10^6$ cells per milliliter in RPMI medium supplemented with 10% (v/v) fetal bovine serum, antibiotics, and L-glutamine. The cells were maintained at 37° C. in a humidified incubator, and were harvested 4, 14, and 24 hours following re-suspension. Total RNA was isolated from the cells by guanidinium isothiocyanate/beta-mercaptoethanol lysis followed by cesium chloride gradient centrifugation. Isolated RNA was treated with DNase, and the poly-A-containing fraction of total RNA was further purified using OLIGOTEX™ beads (Qiagen, Inc.). About 4.4 micrograms of poly-A-containing RNA was used to synthesize a cDNA library using the Superscript™ cDNA synthesis kit (Gibco BRL, Inc.; Gaithersburg, Md.). cDNA was directionally cloned into expression plasmid pMET7 vectors using SalI and NotI polylinker restriction endonuclease sites in order to generate a plasmid library. Transformants were randomly selected and expanded in culture for single-pass nucleotide sequencing.

The invention includes nucleic acid molecules which encode a polypeptide of the invention. Such nucleic acids include, for example, a DNA molecule having the nucleotide sequence listed in one of SEQ ID NOs: 81, 91, 96, 101, 106, and 111, such as the portion which encodes INTERCEPT 289 protein or a domain (e.g., the extracellular domain) of INTERCEPT 289 protein. These nucleic acids are collectively referred to as nucleic acids of the invention.

In each form, INTERCEPT 289 protein includes a transmembrane domain and a portion corresponding to an extra-membrane (presumably extracellular) domain. In alternative embodiments, this extra-membrane domain is a cytoplasmic domain. The transmembrane domain corresponds to about amino acid residues 7 to 27 of SEQ ID NO: 83 (i.e., SEQ ID NO: 84 in form 1a), to about amino acid residues 7 to 27 of SEQ ID NO: 93 (i.e., SEQ ID NO: 94 in form 1b), to about amino acid residues 7 to 27 of SEQ ID NO: 98 (i.e., SEQ ID NO: 99 in form 2a), to about amino acid residues 7 to 27 of SEQ ID NO: 103 (i.e., SEQ ID NO: 104 in form 2b), to about amino acid residues 7 to 28 of SEQ ID NO: 108 (i.e., SEQ ID NO: 109 in form 3a), and to about amino acid residues 7 to 28 of SEQ ID NO: 113 (i.e., SEQ ID NO: 114 in form 3b).

Each form of INTERCEPT 289 protein also includes another extra-membrane portion. This portion corresponds to about amino acid residues 28 to 188 of SEQ ID NO: 83 (i.e., SEQ ID NO: 85 in form 1a), to about amino acid residues 28 to 178 of SEQ ID NO: 93 (i.e., SEQ ID NO: 95 in form 1b), to about amino acid residues 28 to 165 of SEQ ID NO: 98 (i.e., SEQ ID NO: 100 in form 2a), to about amino acid residues 28 to 155 of SEQ ID NO: 103 (i.e., SEQ ID NO: 105 in form 2b), to about amino acid residues 29 to 145 of SEQ ID NO: 108 (i.e., SEQ ID NO: 110 in form 3a), and to about amino acid residues 29 to 135 of SEQ ID NO: 113 (i.e., SEQ ID NO: 115 in form 3b).

INTERCEPT 289 proteins and nucleic acid molecules encoding them comprise a family of molecules having certain conserved structural and functional features, as illustrated in FIGS. 8 and 9A-9N.

In FIG. 8, the amino acid sequences of various forms of INTERCEPT 289 ("A"-"F"; SEQ ID NOs: 83, 93, 98, 103, 108, and 113) are shown, as aligned using the Wisconsin™ BestFit software (Smith and Waterman, (1981) Adv. Appl. Math. 2:482-489; blosum62 scoring matrix; gap opening penalty 10/gap extension penalty 10). In FIGS. 9A-9N, the nucleotide sequences (SEQ ID NOs: 81, 91, 96, 101, 106, and 11) of cDNA molecules encoding the six forms of INTERCEPT 289 protein described herein are aligned using the Wisconsin™ BestFit software (Smith and Waterman, (1981) Adv. Appl. Math. 2:482-489; gap opening penalty 10/gap extension penalty 10). As indicated in these figures, the various forms of INTERCEPT 289 protein differ in the length of the polypeptide sequence between the transmembrane domain and the lectin C-type domain described below and in the amino acid sequence of the carboxyl-terminal portion of the protein.

INTERCEPT 289 proteins typically comprise a variety of potential post-translational modification sites and protein domains (often positioned within a domain located at or near the protein surface), such as those described herein in Table IVA, as predicted by computerized sequence analysis of INTERCEPT 289 proteins using amino acid sequence comparison software (comparing the amino acid sequence of INTERCEPT 289 with the information in the PROSITE database {rel. 12.2; February 1995} and the Hidden Markov Models database {Rel. PFAM 3.3}).

TABLE IV A

| Type of Potential Modification Site or Domain | Amino Acid Residues of SEQ ID NO: ## (INTERCEPT 289 form) | | | | | | Amino Acid Sequence |
|---|---|---|---|---|---|---|---|
| | 83 (1a) | 93 (1b) | 98 (2a) | 103 (2b) | 108 (3a) | 113 (3b) | |
| N-glycosylation site | 32-35 | 32-35 | 32-35 | 32-35 | | | NKSN |
| | 93-96 | 93-96 | 70-73 | 70-73 | 50-53 | 50-53 | NESR |
| | 144-147 | 144-147 | 121-124 | 121-124 | 101-104 | 101-104 | NNSV |
| | 151-154 | | 128-131 | | 108-111 | | NVTN |
| Protein kinase C phosphorylation site | 40-42 | 40-42 | 40-42 | 40-42 | | | TTR |
| | 63-65 | 63-65 | | | | | TTR |
| | 178-180 | | 155-157 | | 135-137 | | SYR |
| Casein kinase II phosphorylation site | 86-89 | 86-89 | 63-66 | 63-66 | 43-46 | 43-46 | STSE |
| | 91-94 | 91-94 | 68-71 | 68-71 | 48-51 | 48-51 | SWNE |
| | 122-125 | 122-125 | 99-102 | 99-102 | 79-82 | 79-82 | TDAE |
| | | 168-171 | | 145-148 | | 125-128 | TKPE |
| N-myristoylation site | 103-108 | 103-108 | 80-85 | 80-85 | 60-65 | 60-65 | GSTLAI |
| | 150-155 | | 127-132 | | 107-112 | | GNVTNQ |
| | 165-170 | | 142-147 | | 122-127 | | GLTKTF |
| Lectin C-type domain | 97-183 | 97-170 | 74-160 | 74-147 | 54-140 | 54-127 | |

In various embodiments, the protein of the invention has at least 1, 2, 4, 6, 8, 12, or more of the post-translational modification sites and domains described in Table IVA.

An example of an additional domain present in INTERCEPT 289 proteins is a lectin C-type domain. In one embodiment, the protein of the invention has at least one domain or signature sequence that is at least 55%, preferably at least about 65%, 75%, 85%, or 95% identical to this domain. C-type lectin domains are conserved among proteins (e.g., animal lectins) which are involved in calcium-dependent binding of carbohydrates, although it has recently been recognized that these domains can also be involved in binding of proteins (Drickamer, (1988) J. Biol. Chem. 263:9557-9560; Drickamer, (1993) Prog. Nucl. Acid Res. Mol. Biol. 45:207-232; Drickamer, (1993) Curr. Opin. Struct. Biol. 3:393-400). C-type lectins and their relevant properties are described in greater in P.C.T. Publication No. WO 98/28332, which, as with all references cited herein, is incorporated by reference.

A cDNA clone (designated jtmMa127f05) encoding at least a portion of murine INTERCEPT 289 protein was also isolated. Murine INTERCEPT 289 protein is a transmembrane protein. The properties of murine INTERCEPT 289 are described below.

Murine INTERCEPT 289 protein includes a transmembrane domain and a portion corresponding to an extra-membrane domain. In one embodiment, the domain is extracellular; in an alternative embodiments, this extra-membrane domain is a cytoplasmic domain. The transmembrane domain corresponds to about amino acid residues 7 to 27 of SEQ ID NO: 163 (i.e., SEQ ID NO: 164), and the extra-membrane portion corresponds to about amino acid residues 28 to 190 of SEQ ID NO: 163 (i.e., SEQ ID NO: 165).

Murine INTERCEPT 289 proteins typically comprise a variety of potential post-translational modification sites and protein domains (often positioned within a domain located at or near the protein surface), such as those described herein in Table IVB, as predicted by computerized sequence analysis of murine INTERCEPT 289 protein using amino acid sequence comparison software (comparing the amino acid sequence of murine INTERCEPT 289 with the information in the PROSITE database {rel. 12.2; February 1995} and the Hidden Markov Models database {Rel. PFAM 3.3}).

TABLE IVB

| Type of Potential Modification Site or Domain | Amino Acid Residues of SEQ ID NO: 163 | Amino Acid Sequence |
|---|---|---|
| N-glycosylation site | 51 to 54 | NVSQ |
| | 146 to 149 | NNSV |
| | 153 to 156 | NVTN |
| Protein kinase C phosphorylation site | 180 to 182 | SYR |
| Casein kinase II phosphorylation site | 88 to 91 | SFSE |
| | 155 to 158 | TNQD |
| N-myristoylation site | 105 to 110 | GSTLAI |
| | 152 to 157 | GNVTNQ |
| | 167 to 172 | GLTKTY |
| Lectin C-type domain | 99 to 185 | |

In various embodiments, the protein of the invention has at least 1, 2, 4, 6, 8, or more of the post-translational modification sites and domains described in Table IVB.

INTERCEPT 289 proteins and cDNAs exhibit homology with human myeloid DAP12 (DNAX accessory protein, 12 kilodalton) associated lectin-1 (MDL-1), which is described in PCT Publication No. WO 99/06557, which is also incorporated herein by reference. In FIG. 8, the amino acid sequences of various forms of INTERCEPT 289 ("A"-"F" and "R"; SEQ ID NOs: 83, 93, 98, 103, 108, 113, and 163, respectively), human MDL-1 ("H"; SEQ ID NO: 86), and murine MDL-1 ("M"; SEQ ID NO: 88) proteins are shown, as aligned using the Wisconsin™ BestFit software (Smith and Waterman, (1981) Adv. Appl. Math. 2:482-489; BLOSUM62 scoring matrix; gap opening penalty 10/gap extension penalty 10). Each of the seven forms of INTERCEPT 289 protein described herein has a lysine residue (i.e., at residue 116 of SEQ ID NOs: 83 and 93, at residue 93 of SEQ ID NOs: 98 and 103, at residue 73 of SEQ ID NOs: 108 and 113, and at residue 118 of SEQ ID NO: 163) that is not present in the described sequence (SEQ ID NO: 86) of human MDL-1 protein.

In the alignment shown in FIG. 8, the amino acid sequence (SEQ ID NO: 83) of form 1a of INTERCEPT 289 protein is 100% identical to that of human MDL-1 over the 187-amino acid residue overlapping region and about 72.7% identical to that of murine MDL-1 in the 165-amino acid residue overlapping region.

In the alignment shown in FIG. 8, the amino acid sequence (SEQ ID NO: 93) of form 1b of INTERCEPT 289 protein is about 85.9% identical to that of human MDL-1 over the 177-amino acid residue overlapping region and about 60.0% identical to that of murine MDL-1 in the 155-amino acid residue overlapping region.

In the alignment shown in FIG. 8, the amino acid sequence (SEQ ID NO: 98) of form 2a of INTERCEPT 289 protein is 100% identical to that of human MDL-1 over the 164-amino acid residue overlapping region and about 71.5% identical to that of murine MDL-1 in the 165-amino acid residue overlapping region.

In the alignment shown in FIG. 8, the amino acid sequence (SEQ ID NO: 103) of form 2b of INTERCEPT 289 protein is about 83.8% identical to that of human MDL-1 over the 154-amino acid residue overlapping region and about 58.7% identical to that of murine MDL-1 in the 155-amino acid residue overlapping region.

In the alignment shown in FIG. 8, the amino acid sequence (SEQ ID NO: 108) of form 3a of INTERCEPT 289 protein is about 83.3% identical to that of human MDL-1 over the 144-amino acid residue overlapping region and about 74.5% identical to that of murine MDL-1 in the 145-amino acid residue overlapping region.

In the alignment shown in FIG. 8, the amino acid sequence (SEQ ID NO: 113) of form 3b of INTERCEPT 289 protein is about 63.4% identical to that of human MDL-1 over the 134-amino acid residue overlapping region and about 60.0% identical to that of murine MDL-1 in the 135-amino acid residue overlapping region.

In the alignment shown in FIG. 8, the amino acid sequence (SEQ ID NO: 163) of murine INTERCEPT 289 protein is 100% identical to that of murine MDL-1 over the 190-amino acid residue overlapping region and about 85.7% identical to that of human MDL-1 in the 188-amino acid residue overlapping region.

In the alignment shown in FIGS. 11A-B, the nucleotide sequence (SEQ ID NO: 162) of the ORF of murine INTERCEPT 289 is about 71.8% identical to that of the ORF of human INTERCEPT 289 form 1a.

MDL-1 is a cell surface protein which is expressed by monocytes and macrophages and which binds with DAP12. DAP12 is a cell surface protein which is expressed by natural killer cells, peripheral blood granulocytes and monocytes, macrophages, and dendritic cells. DAP12 is an immunoreceptor tyrosine-based activation motif-containing protein which associates non-covalently with activating isoforms of MHC class I receptors on natural killer cells (Bakker et al., 1999, Proc. Natl. Acad. Sci. USA 96:9792-9796). Association of MDL-1 and DAP12 on the surface of monocytes and macrophages and binding of associated MDL-1/DAP12 with a ligand thereof (e.g., a surface protein, glycoprotein, or glycolipid on the surface of another cell of the same animal or on the surface of a foreign cell) causes activation of those cells. Upon activation, and depending on the type of the monocyte/macrophage, the monocyte/macrophage generates an oxidative burst, produces one or more cytokines, and other leukocyte-modulating molecules, releases one or more cytokines other leukocyte-modulating molecules, or some combination of these activities. MDL-1 and, by analogy, INTERCEPT 289 are therefore involved in modulation of immune function, including modulation of antibody and cytotoxic T cell responses, expansion of immune cell populations, inflammation, and generation of memory B cells.

The amino acid sequences (SEQ ID NOs: 83, 93, 98, 103, 108, and 113) of the six forms of INTERCEPT 289 protein described herein were aligned with the amino acid sequence of CD94 protein (GenBank Accession No. 5542082) using the Wisconsin™ BestFit software (Smith and Waterman, (1981) Adv. Appl. Math. 2:482-489; BLOSUM62 scoring matrix; gap opening penalty 10/gap extension penalty 10). The amino acid sequence identity between CD94 protein and INTERCEPT 289 protein was 28.0% for form 1a in the 126-amino acid residue overlapping region, 25.2% for form 1b in the 115-amino acid residue overlapping region, 28.0% for form 2a in the 125-amino acid residue overlapping region, 25.2% for form 2b in the 127-amino acid residue overlapping region, 27.2% for form 3a in the 125-amino acid residue overlapping region, and 24.3% for form 3b in the 115-amino acid residue overlapping region. CD94 protein is a cell-surface protein which has a C-type lectin domain in its carboxyl terminal portion and which acts as a receptor for natural killer (NK) cells. CD94 modulates the cytotoxic activity of NK cells, as well as production of cytokines by NK cells.

FIGS. 10A-10F depict hydrophobicity plots of the six forms of human INTERCEPT 289 protein described herein. Form 1a corresponds to FIG. 10A, and has the amino acid sequence SEQ ID NO: 83. Form 1b corresponds to FIG. 10B, and has the amino acid sequence SEQ ID NO: 93. Form 2a corresponds to FIG. 10C, and has the amino acid sequence SEQ ID NO: 98.

Figure 12:
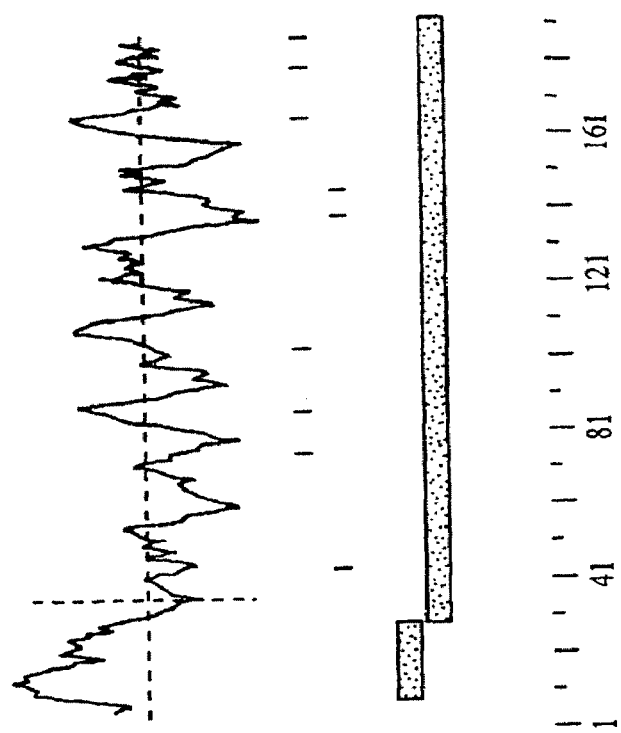
FIG. 12 is a hydrophobicity plot for murine INTERCEPT 289 protein.

Form 2b corresponds to FIG. 10-D, and has the amino acid sequence SEQ ID NO: 103. Form 3a corresponds to FIG. 10E, and has the amino acid sequence SEQ ID NO: 108. Form 3b corresponds to FIG. 10F, and has the amino acid sequence SEQ ID NO: 113. Relatively hydrophobic regions are above the dashed horizontal line, and relatively hydrophilic regions are below the dashed horizontal line. As described elsewhere herein, relatively hydrophilic regions are generally located at or near the surface of a protein, and are more frequently effective immunogenic epitopes than are relatively hydrophobic regions. FIG. 12 depicts a hydrophobicity plot of the murine INTERCEPT 289 protein described herein.

The predicted molecular weights of the six forms of human INTERCEPT 289 protein described herein, without modification, is about 21.5 kilodaltons for form 1a, about 20.4 kilodaltons for form 1b, about 19.1 kilodaltons for form 2a, about 18.0 kilodaltons for form 2b, about 16.9 kilodaltons for form 3a, and about 15.8 kilodaltons for form 3b. The predicted molecular weight of murine INTERCEPT 289, without modification is about 21.7 kilodaltons.

Expression of one or more forms of INTERCEPT 289 was detected in cDNA libraries prepared using human tissue and cell samples listed in Table V, wherein "+" indicates detectable expression and "+/−" indicates weakly detectable expression.

TABLE V

| cDNA library | Expression |
| --- | --- |
| Promyelocytic Leukemia Cells | + |
| Bone Marrow | + |
| D8 Dendritic Cells | +/− |
| Ovarian Ascites | +/− |
| Aortic Endothelial Cells | +/− |
| Congestive Heart Failure (left ventricle) | +/− |

Uses of INTERCEPT 289 Nucleic Acids, Polypeptides, and Modulators Thereof

INTERCEPT 289 proteins are involved in disorders which affect both tissues in which they are normally expressed and tissues in which they are normally not expressed. Based on the observations that cDNA corresponding to INTERCEPT 289 occurs in a human mixed lymphocyte reaction cDNA library, and that RNA corresponding to INTERCEPT 289 is detectable by PCR amplification, using primers which specifically amplify INTERCEPT 289 sequences, of nucleic acids (e.g., mRNA or cDNA) obtained from human leukemia, bone marrow, dendritic, ovarian ascitic, aortic endothelial, and cardiac (e.g., left ventricle cells obtained from a heart afflicted with congestive heart failure) cells, it is evident that INTERCEPT 289 protein can be involved in one or more biological processes which occur in these cells and in tissues which contain them. In particular, INTERCEPT 289 is involved in modulating growth, proliferation, survival, differentiation, and activity of cells of these cells and tissues (e.g., lymphocytes). Examples of disorders of such cells and issues include various cancers (e.g., leukemias, lymphomas, and endothelial cancers such as ovarian cancers), atherosclerosis, arteriosclerosis, coronary artery disease, immune insufficiency disorders, immune hypersensitivity disorders, and congestive heart failure disorders (e.g., myocardial infarction, cardiomegaly, and cardiac valvular defects). INTERCEPT 289 proteins, nucleic acids encoding them, and agents that modulate activity or expression of either of these can be used to prognosticate, diagnose, and treat one or more of these disorders.

Presence of a C-type lectin domain in INTERCEPT 289 is an indication that this protein can specifically recognize particular surfaces, such as the surface of cells of a particular type. Further supportive of this observation is the fact that human INTERCEPT 289 proteins exhibit significant sequence identity with MDL-1 which, in cooperation with DAP12 protein associated therewith, is capable of binding one or more ligands and activating one or more types of macrophages and monocytes. Aberrant activation of macrophages and monocytes is associated with a variety of immunological disorders including, for example, inflammation, asthma, hypersensitivity disorders (e.g., allergies), atopic disorders (e.g., allergic rhinitis, allergic asthma, and atopic dermatitis), anaphylaxis, urticaria (i.e., hives), auto-immune disorders (e.g., rheumatoid and juvenile arthritis, rheumatism, systemic lupus erythamatosus, Grave's disease, and multiple sclerosis), graft and transplant rejection, leukemias (e.g., ALL, CML, CLL, and myelodysplastic syndrome), blood dyscrasias (e.g., multiple myeloma), polycythemia vera, myelofibrosis, leukopenias, lymphomas (e.g., Hodgkin's disease, non-Hodgkin's lymphoma, Burkitt's lymphoma, and mycosis fungoides), bacterial, viral, and parasitic infections (e.g., sepsis, influenza, common colds, hepatitis, HIV infection, malaria, and gonorrhea), immune insufficiency (e.g., AIDS), and immunodeficiency disorders. INTERCEPT 289 proteins, nucleic acids encoding them, and agents that modulate activity or expression of either of these can be used to prognosticate, diagnose, and treat one or more of these disorders.

INTERCEPT 309

A cDNA clone (designated jthYa038a01t1) encoding at least a portion of human INTERCEPT 309 protein was isolated from a human thyroid tissue cDNA library. Human INTERCEPT 309 protein is an integral membrane protein having three transmembrane regions and a fourth transmembrane region that can act as a signal sequence. Human INTERCEPT 309 protein is a claudin-like protein.

The full length of the cDNA encoding human INTERCEPT 309 protein (SEQ ID NO: 121) is 1909 nucleotide residues. The ORF of this cDNA, nucleotide residues 2 to 646 of SEQ ID NO: 121 (i.e., SEQ ID NO: 122), encodes an approximately 215-amino acid residue integral membrane protein (SEQ ID NO: 123) having three transmembrane regions in its mature (181-amino acid residue; SEQ ID NO: 138) form.

The invention includes nucleic acid molecules which encode a polypeptide of the invention. Such nucleic acids include, for example, a DNA molecule having the nucleotide sequence listed in SEQ ID NO: 121, such as the portion which encodes mature INTERCEPT 309 protein, immature INTERCEPT 309 protein, or a domain of INTERCEPT 309 protein. These nucleic acids are collectively referred to as nucleic acids of the invention.

INTERCEPT 309 proteins and nucleic acid molecules encoding them comprise a family of molecules having certain conserved structural and functional features.

A common domain present in INTERCEPT 309 proteins is a signal sequence. In one embodiment, a INTERCEPT 309 protein contains a signal sequence corresponding to about amino acid residues 1 to 24 of SEQ ID NO: 123 (SEQ ID NO: 124). It is recognized that the carboxyl terminal boundary of the signal sequence can be located one or two residues from the residue identified above (i.e., following residues 22, 23, 24, 25, or 26 of SEQ ID NO: 123). The signal sequence is cleaved during processing of the mature protein.

INTERCEPT 309 proteins include three transmembrane domains and two pairs of extra-membrane domains that flank the cell membrane. The three transmembrane domains correspond to about amino acid residues 72 to 92, 108 to 131, and 154 to 178 of SEQ ID NO: 123 (i.e., the transmembrane domains having the sequences SEQ ID NOs: 126, 128, and 130, respectively). One pair of extra-membrane domains corresponds to about amino acid residues 25 to 71 and 132 to 153 of SEQ ID NO: 123 (these domains having the sequences SEQ ID NOs: 125 and 129). The other pair of extra-membrane domains corresponds to about amino acid residues 93 to 107 and 179 to 215 of SEQ ID NO: 123 (these domains having the sequences SEQ ID NOs: 127 and 131). In one embodiment, the first pair of extra-membrane domains (i.e., those having the sequences SEQ ID NOs: 125 and 129) are extracellular domains and the other pair of domains are cytoplasmic domains. However, in an alternative form, the first pair of extra-membrane domains are cytoplasmic and the other pair are extracellular domains.

It is recognized that, in certain forms, INTERCEPT 309 proteins can have an additional number of amino acid residues at their amino terminus. For example, the proteins can have from 1 to about 30 amino acid residues, more commonly 1 to about 12, 1 to about 10, or 1 to about 5 residues.

INTERCEPT 309 proteins typically comprise a variety of potential post-translational modification sites and protein domains (often positioned within an extracellular or protein surface domain), such as those described herein in Table VI, as predicted by computerized sequence analysis of INTERCEPT 309 proteins using amino acid sequence comparison software (comparing the amino acid sequence of INTERCEPT 309 with the information in the PROSITE database {rel. 12.2; Feb, 1995} and the Hidden Markov Models database {Rel. PFAM 3.3}).

TABLE VI

| Type of Potential Modification Site or Domain | Amino Acid Residues of SEQ ID NO: 123 | Amino Acid Sequence |
|---|---|---|
| Protein kinase C phosphorylation site | 184 to 186 | SYR |
| | 191 to 193 | SHR |
| | 195 to 197 | TQK |
| | 201 to 203 | TGK |
| Tyrosine kinase phosphorylation site | 149 to 156 | RELGEALY |
| N-myristoylation site | 7 to 12 | GMVGTV |
| | 39 to 44 | GLWMNC |
| | 72 to 77 | GLMCAA |
| | 91 to 96 | GMKCTR |
| | 169 to 174 | GALFCC |
| Amidation site | 201 to 204 | TGKK |

In various embodiments, the protein of the invention has at least 1, 2, 4, 6, or all 11 of the post-translational modification sites and domains described herein in Table VI.

Figure 13:
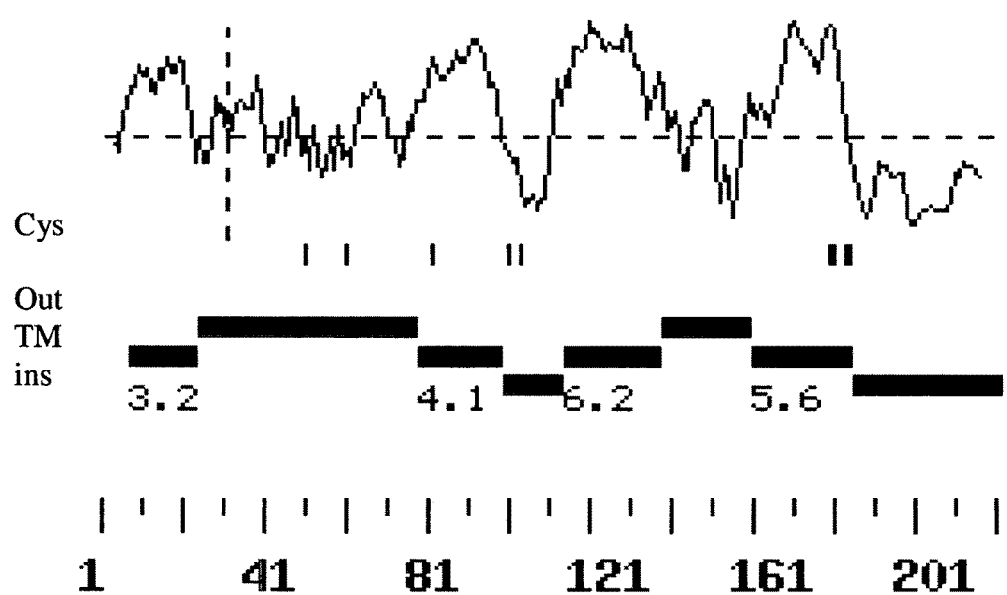
FIG. 13 is a hydrophobicity plot of human INTERCEPT 309 protein.
Figure 14G:
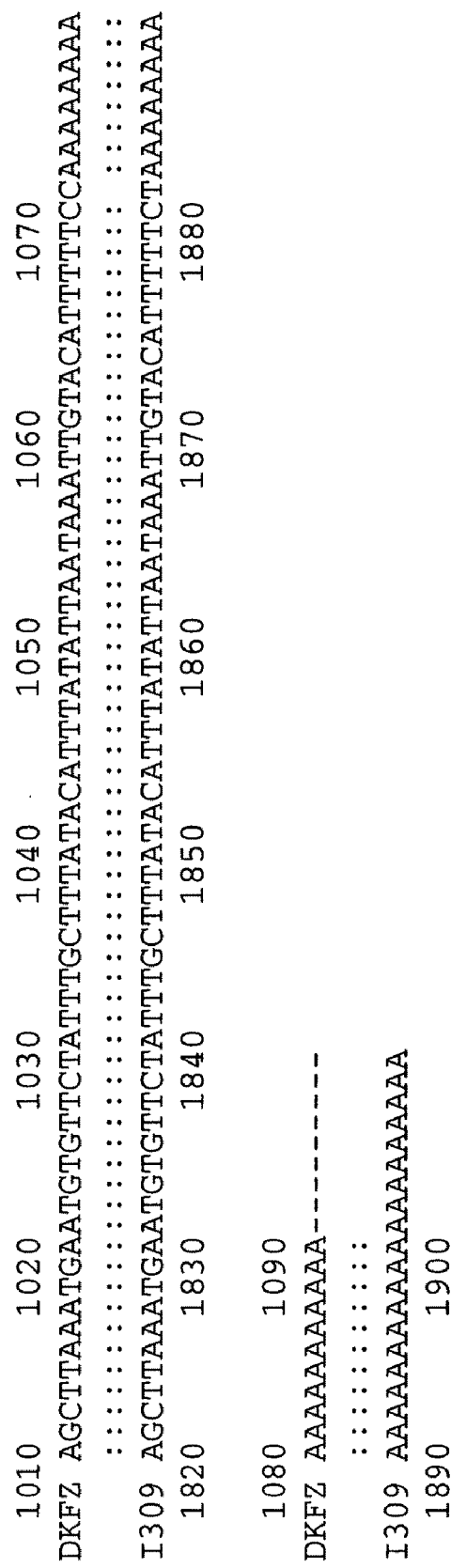

FIG. 13 depicts a hydrophobicity plot of an embodiment of human INTERCEPT 309 protein. Relatively hydrophobic regions are above the dashed horizontal line, and relatively hydrophilic regions are below the dashed horizontal line. The hydrophobic regions which corresponds to about amino acid residues 72 to 92, 108 to 131, and 154 to 178 of SEQ ID NO: 123 are the transmembrane domains of human INTERCEPT 309 described above. As described elsewhere herein, relatively hydrophilic regions are generally located at or near the surface of a protein, and are more frequently effective immunogenic epitopes than are relatively hydrophobic regions. For example, the region of human INTERCEPT 309 protein from about amino acid residue 90 to about amino acid residue 100 appears to be located at or near the surface of the protein, while the region from about amino acid residue 70 to about amino acid residue 85 appears not to be located at or near the surface.

The predicted molecular weight of human INTERCEPT 309 protein without modification and prior to cleavage of the signal sequence is about 23.8 kilodaltons. The predicted molecular weight of the mature human INTERCEPT 309 protein without modification and after cleavage of the signal sequence is about 21.4 kilodaltons.

INTERCEPT 309 protein exhibits amino acid sequence homology with murine claudin-8 protein, as indicated in the alignment (made using the ALIGN software {Myers and Miller (1989) CABIOS, ver. 2.0}; pam120.mat scoring matrix; gap opening penalty=12, gap extension penalty=4) of the amino acid sequences of INTERCEPT 309 (SEQ ID NO: 123) and murine claudin-8 (SEQ ID NO: 132) proteins shown in FIG. 16. In this alignment, the two amino acid sequences are about 80.0% identical. Furthermore, INTERCEPT 309 cDNA (SEQ ID NO: 121) is about 83.1% identical to the nucleotide sequence of cDNA encoding murine claudin-8 (SEQ ID NO: 133; GenBank accession no. AF087826) over the 639-residue overlapping region, as indicated in the alignment (made using the ALIGN software; pam120.mat scoring matrix; gap opening penalty=12, gap extension penalty=4) shown in FIGS. 15A-15G.

An alignment (made using the ALIGN software; pam120.mat scoring matrix; gap opening penalty=12, gap extension penalty=4) of the nucleotide sequences of a cDNA clone (SEQ ID NO: 134; GenBank accession no. AL049977) obtained from human fetal brain tissue and INTERCEPT 309 cDNA (SEQ ID NO: 121) is shown in FIGS. 14A-14G and indicates 100% sequence identity between the sequences in the overlapping portion. The overlapping portion does not overlap the INTERCEPT 309 ORF, with the exception of nucleotide residues 1 and 28-32. It is recognized that 'overlap' of the human fetal brain cDNA clone sequence with these ORF residues is an artifact of the ALIGN software, and does not represent meaningful homology between residues 1 and 28-32 of the INTERCEPT 309 ORF and the corresponding residues of the human fetal brain cDNA clone. Nonetheless, isolation of this cDNA clone from fetal brain tissue is an indication that INTERCEPT 309 protein is expressed in fetal brain tissue.

An alignment (made using the LALIGN software {Huang and Miller, 1991, Adv. Appl. Math. 12:373-381}; pam120 scoring matrix, gap opening penalty=12, gap extension penalty=4) of the nucleotide sequence of INTERCEPT 309 cDNA (SEQ ID NO: 121) with the nucleotide sequence encoding murine latent transforming growth factor-beta binding protein-3 (LTBP-3) indicated that the two sequences were 40.3% identical in a 1969-nucleotide residue overlapping portion.

As disclosed in P.C.T. Publication No. WO 95/22611, latent transforming growth factor-beta binding protein 3 (LTBP-3) is a secreted protein that is expressed in murine epithelial, parenchymal, and stromal during embryonic development. LTBP-3 is thought to exhibit one or more of four activities i) modulating intracellular-biosynthesis of latent transforming growth factor-beta;

ii) binding latent transforming growth factor-beta with extracellular matrix;

iii) modulating activation of latent transforming growth factor-beta complexes; and iv) targeting latent transforming growth factor-beta complexes to the cell surface.

An alignment (made using the ALIGN software; pam120.mat scoring matrix, gap opening penalty=12, gap extension penalty=4) of the amino acid sequence of INTERCEPT 309 cDNA (SEQ ID NO: 123) with the amino acid sequence of human peripheral myelin protein (PMP-22) indicated that the two protein sequences are 17.2% identical. PMP-22 is involved in myelination of peripheral nerves, particularly during development.

Individual alignments (made using the Wisconsin™ BestFit software; Smith and Waterman (1981) Adv. Appl. Math. 2:482-489; blosum62 scoring matrix, gap opening penalty 10/gap extension penalty 10) of the amino acid sequence (SEQ ID NO: 123) of INTERCEPT 309 with the amino acid sequences of human (SEQ ID NO: 135; GenBank Accession No. 4502877) and murine (SEQ ID NO: 136; GenBank Accession No. BAA22985) receptors of Clostridium perfringens enterotoxin (CPE) and with the amino acid sequence (SEQ ID NO: 137) encoded by rat ventral prostate tissue during androgen withdrawal-induced tissue regression were manually aligned (by inserting a 'blank' at position 1 of the rRPV nucleotide sequence). The manually aligned alignments are shown in FIG. 17. The amino acid sequence of INTERCEPT 309 protein is about 43% identical to the human CPE receptor amino acid sequence, about 45% identical to the murine CPE receptor amino acid sequence, and about 43% identical to the amino acid sequence encoded by the transcript obtained from regressing rat ventral prostate tissue.

Expressed sequence tags (ESTs) which exhibit at least limited nucleotide sequence identity with SEQ ID NO: 121 have been isolated from human and murine liver, kidney, prostate, and colon tissues.

Uses of INTERCEPT 309 Nucleic Acids, Polypeptides, and Modulators Thereof

INTERCEPT 309 proteins are involved in disorders which affect both tissues in which they are normally expressed and tissues in which they are normally not expressed. Based on the observations that cDNA corresponding to INTERCEPT 309 occurs in human thyroid and fetal brain cDNA libraries, and that ESTs have been isolated from liver, kidney, prostate, and colon tissues, it is evident that INTERCEPT 309 protein is involved in one or more biological processes which occur in these tissues. In particular, INTERCEPT 309 is involved in modulating growth, proliferation, survival, differentiation, and activity (e.g., thyroid secretion activity) of cells of these tissues. Thus, INTERCEPT 309 has a role in disorders which affect the brain, thyroid, and other tissues and one or more of growth, proliferation, survival, differentiation, activity, morphology, and movement/migration of cells in those tissues, as well as the biological function of organs (e.g., the brain, liver, colon, prostate, kidneys, and thyroid) comprising such tissues. Relevant disorders which involve these tissues are discussed separately below.

As indicated by its similarity to murine claudin-8 (e.g., as shown in FIG. 16), INTERCEPT 309 is a claudin-like protein, and can exhibit one or more of the activities exhibited by murine claudin-8 and other claudins. Claudins are proteins that are involved in formation, maintenance, and regulation of tight junctions, which are intercellular junctions that occur between cells of tissues (e.g., epithelia and endothelia) having selective permeability (Morita et al. (1999) Proc. Natl. Acad. Sci. USA 96:511-516). Tight junctions can be associated with actin fibrils, and claudins can mediate interactions between actin fibrils and other components of the tight junction. Tissues in which tight junctions occur between adjacent cells can form sheets or other structures which exhibit selective trans-tissue permeability and in which the membrane and membrane-bound components of tissue-spanning cells can be selectively localized to one side (e.g., apical or basolateral side) of the tissue. By way of example, epithelial and endothelial tissues of kidney, liver, lung, and thyroid form barriers which permit transepithelial/transendothelial passage of certain compounds and cells (e.g., secreted/excreted products and immune system cells), but not others. Tight junction alterations have also been associated with tumor differentiation, particularly in thyroid tumors (Kerjaschki et al. (1979) Am. J. Pathol. 96:207-225; Cochand-Priollet et al. (1998) Ultrastruct. Pathol. 22:413-420). INTERCEPT 309 can have a role in each of these functions, both in normal tissue and in aberrant tissue (e.g., tissue of a patient afflicted with a disorder that affects the tissue).

An important feature of tight junctions is that the permeability of a tissue comprising such intercellular junctions can be regulated by cellular and other (e.g., endocrine) processes. Thus, depending on the cellular or other influences exerted on the components of the tight junction, the permeability of the tissue to water, solutes (e.g., urea), proteins (e.g., hormones), and immune cells (e.g., T cells and macrophages) can be regulated (Stevenson (1999) J. Clin. Invest. 104:3-4). Regulation of transmembrane permeability is critical to the function of many organs (e.g., kidney, colon, thyroid, liver, prostate, etc.). INTERCEPT 309, being a claudin-like protein can regulate transmembrane permeability in organs and tissues in which it is normally or aberrantly expressed.

One or more transmembrane proteins associated with tight junctions mediate transmembrane signal transduction which regulates, inter alia, the permeability of the junction (Fanning et al., (1999) J. Am. Soc. Nephrol. 10:1337-1345). For example, inhibition of protein tyrosine phosphorylation (a common activity associated with transmembrane signaling) has been associated with aberrant thyroid epithelial cell junction formation (Yap et al., (1997) Endocrinology 138:2315-2324). INTERCEPT 309, being a transmembrane protein associated with tight junctions and having a potential tyrosine kinase phosphorylation site at residues 149-156 of SEQ ID NO: 123, can be involved in transmembrane transduction of signals between the cell interior and the extracellular milieu, including signal transduction associated with regulation of tight junction function.

Claudins can also participate in cell-to-cell adhesive processes that do not necessarily involve tight junction formation. Examples of such mechanisms include binding between cells forming the blood-brain barrier, adhesion of myelin to nerve fibers and to itself, and binding between skin cells to form a barrier to the passage of moisture and solutes to and from the environment. Similarity between the amino acid sequences of INTERCEPT 309 and PMP-22 is also indicative of a role of INTERCEPT 309 protein in mediating adhesion between myelin-producing cells and nerve cells (e.g., between Schwann cells and peripheral nerve cells). INTERCEPT 309 can therefore have a role in disorders (e.g., multiple sclerosis) involving aberrant (including insufficient) myelination or demyelination of nerve cells.

INTERCEPT 309, being a cell surface claudin-like protein, can be a substrate for interaction of pathogens (e.g., bacteria, toxins, and viruses) with host cells, and can mediate interaction of pathogens with cells which express INTERCEPT 309.

For example, Morita et al. (supra) determined that a murine claudin is a receptor for Clostridium perfringens enterotoxin (CPE). Similarity between the amino acid sequences of murine claudin-8 and INTERCEPT 309 indicates that INTERCEPT 309 can act as a receptor for CPE. Furthermore, amino acid sequence similarity between INTERCEPT 309 and other human and murine CPE receptors (e.g., GenBank Accession Nos. 4502877 and BAA22985, as indicated in FIG. 17) is a further indication that INTERCEPT 309 can mediate interaction of CPE with cells upon which CPE acts. INTERCEPT 309 proteins, nucleic acids encoding them, and agents that modulate activity or expression of either of these can be used to prognosticate, diagnose, and treat disorders mediated by *C. perfringens*. Such disorders include, by way of example, gastrointestinal disorders (e.g., diarrhea, gastroenteritis, and other disorders associated with food poisoning, and certain types of pseudomembranous colitis), disorders associated with wound healing (e.g., gangrene), and other pathogenic infections (e.g., sepsis with or without intravascular hemolysis). INTERCEPT 309 can, of course, also mediate interaction of other pathogens with cells which express it.

Being a claudin-like protein, INTERCEPT 309 can be involved in formation, maintenance, and regulation of structures (e.g., transmembrane protein complexes including INTERCEPT 309) that regulate the permeability of cell membranes with regard to various molecules and macromolecules. Regulation of trans-tissue (i.e., intercellular) diffusion of extracellular components (e.g., water, solutes, and immune cells) and diffusion of membrane-bound and integral membrane components from one side of a tissue (e.g., the apical face of an epithelium) to the other (e.g., the basolateral face of the same epithelium; i.e., paracellular diffusion) can be modulated by INTERCEPT 309 proteins and nucleic acids and by small molecules which interact with INTERCEPT 309 proteins and nucleic acids encoding them. Actin is known to be associated with tight junction components, and modifications to the actin cytoskeleton of a cell can modulate tight junction-regulated intercellular and paracellular diffusion. Thus, compositions which affect the interaction between actin and INTERCEPT 309 protein can modulate tight junction regulation of intercellular and paracellular diffusion. In addition, agents which act directly on an INTERCEPT 309 protein or nucleic acid, without affecting the interaction between the claudin and actin, can be used to modulate tight junction regulation of intercellular and paracellular diffusion. INTERCEPT 309 protein can also act as a receptor for *C. perfringens* enterotoxin and for other pathogens, and INTERCEPT 309 proteins, as described herein, can be used to modulate *C. perfringens* enterotoxin binding and toxicity, as well as binding of other pathogens with cells and tissues which express INTERCEPT 309.

The fact that cDNA encoding INTERCEPT 309 was isolated from human thyroid and fetal brain cDNA libraries and the fact that INTERCEPT 309 have been isolated from liver, kidney, prostate, and colon tissues indicates that INTERCEPT 309 can have a role in disorders of these tissues, particularly including those characterized above. Examples of disorders in which INTERCEPT 309 can have a role are described in the following paragraphs a)-f), which are organized, for convenience, by tissue type.

a) Examples of brain disorders in which INTERCEPT 309 can have role include both CNS disorders, CNS-related disorders, focal brain disorders, global-diffuse cerebral disorders, and other neurological and cerebrovascular disorders. CNS disorders include, but are not limited to cognitive and neurodegenerative disorders such as Alzheimer's disease, senile dementia, Huntington's disease, amyotrophic lateral sclerosis, and Parkinson's disease, as well as Gilles de la Tourette's syndrome, autonomic function disorders such as hypertension and sleep disorders (e.g., insomnia, hypersomnia, parasomnia, and sleep apnea), neuropsychiatric disorders (e.g., schizophrenia, schizoaffective disorder, attention deficit disorder, dysthymic disorder, major depressive disorder, mania, and obsessive-compulsive disorder), psychoactive substance use disorders, anxiety, panic disorder, and bipolar affective disorder (e.g., severe bipolar affective disorder and bipolar affective disorder with hypomania and major depression). CNS-related disorders include disorders associated with developmental, cognitive, and autonomic neural and neurological processes, such as pain, appetite, long term memory, and short term memory. Examples of focal brain disorders include aphasia, apraxia, agnosia, and amnesias (e.g., posttraumatic amnesia, transient global amnesia, and psychogenic amnesia). Global-diffuse cerebral disorders with which INTERCEPT 309 is associated include coma, stupor, obtundation, and disorders of the reticular formation. Cerebrovascular disorders include ischemic syndromes (e.g., stroke), hypertensive encephalopathy, hemorrhagic disorders, and disorders involving aberrant function of the blood-brain barrier (e.g., CNS infections such as meningitis and encephalitis, aseptic meningitis, metastasis of non-CNS tumor cells into the CNS, various pain disorders such as migraine, and CNS-related adverse drug reactions such as head pain, sleepiness, and confusion). INTERCEPT 309 proteins, nucleic acids encoding them, and agents that modulate activity or expression of either of these can be used to prognosticate, diagnose, and treat one or more of these disorders.

b) Examples of thyroid disorders with which INTERCEPT 309 proteins and nucleic acids encoding them can be involved include hyper- and hypothyroidism, goiter, thyroiditis, thyroid cancers (e.g., adenomas and carcinomas), and autoimmune diseases involving thyroid autoantigens such as thyroglobulin and thyroperoxidase. INTERCEPT 309 proteins, nucleic acids encoding them, and agents that modulate activity or expression of either of these can be used to prognosticate, diagnose, and treat one or more of these disorders.

c) Kidney disorders with which INTERCEPT 309 proteins and nucleic acids encoding them can be involved include acute and chronic renal failure, immunologically-mediated renal disorders (i.e., involving both renal antigens and extra-renal antigens that have become located within the kidneys), glomerular diseases such as acute and progressive nephritic syndromes and nephrotic syndromes, acute and chronic tubulointerstitial nephritis, infections of the kidney, nephrotoxic disorders (i.e., including those associated with antibiotics, analgesics, anti-cancer agents, anti-epileptic agents, etc.), nephrogenic diabetes insipidus, hereditary chronic nephropathies, urinary incontinence, urinary calculus formation, kidney infections, and kidney neoplasms. INTERCEPT 309 proteins, nucleic acids encoding them, and agents that modulate activity or expression of either of these can be used to prognosticate, diagnose, and treat one or more of these disorders.

d) Examples of liver disorders in which INTERCEPT 309 can have a role include the liver disorders described elsewhere in this disclosure.

e) Prostate disorders with which INTERCEPT 309 proteins and nucleic acids encoding them can be involved include the prostate disorders described elsewhere in this disclosure.

f) Disorders of the colon in which INTERCEPT 309 can have a role include, for example, diarrhea, constipation, gastroenteritis, malabsorption syndromes such as celiac disease and tropical sprue, inflammatory bowel diseases such as Crohn's disease and ulcerative colitis, antibiotic-associated colitis, functional bowel disorders such as irritable bowel syndrome and functional diarrhea, congenital anomalies (e.g., megacolon and imperforate anus), idiopathic disorders (e.g., diverticular disease such as diverticulosis and diverticulitis and melanosis coli), vascular lesions (e.g., ischemic colitis, hemorrhoids, angiodysplasia), inflammatory diseases (e.g., idiopathic ulcerative colitis, pseudomembranous colitis, and lymphopathia venereum), and colon tumors (e.g., hyperplastic polyps, adenomatous polyps, bronchogenic cancer, colonic carcinoma, squamous cell carcinoma, adenoacanthomas, sarcomas, lymphomas, argentaffinomas, carcinoids, and melanocarcinomas). INTERCEPT 309 proteins, nucleic acids encoding them, and agents that modulate activity or expression of either of these can be used to prognosticate, diagnose, and treat one or more of these disorders.

INTERCEPT 309 (like claudins) regulates intercellular permeability in tissues through which one may wish to modulate the passage of drugs or other agents. Such tissues include, for example, the blood-brain barrier (e.g., at the choroid plexus), vascular endothelium, and liver epithelial tissues (i.e., other than fenestrated hepatic vascular epithelia). By way of example, one may wish either to enhance the permeability of a tissue with respect to a drug (e.g., a drug for which enhanced blood-brain barrier permeability is desired) or to reduce the permeability of a tissue with respect to a drug (e.g., a drug for which reduction of hepatic sequestration is desired). INTERCEPT 309 proteins and nucleic acids, and other compounds which modulate the structure or activity of INTERCEPT 309 proteins and nucleic acids, can be used to regulate the permeability of such tissues.

In addition to its structural and functional similarity with claudin proteins, INTERCEPT 309 protein is also similar in sequence to at least one protein regulator of apoptosis. As shown in FIG. 17, the amino acid sequence of INTERCEPT 309 is similar to the amino acid sequence of a protein (rRPV) which is expressed specifically in regressing rat ventral prostate tissue and epididymis. As described by Briehl et al. (1991, Mol. Endocrinol. 5:1381-1388), expression of this rat protein is elevated 3- to 8-fold in ventral prostate tissue upon induction of tissue regression mediated by withdrawal of androgens. Androgen withdrawal induces apoptosis in rat ventral prostate tissue. Thus, the rat protein described by Briehl et al. (supra) is an apoptosis-associated protein. INTERCEPT 309, having a sequence similar to that of rRPV, can also modulate apoptosis in tissues in which it is expressed.

Apoptosis is a process of controlled cell death that occurs normally in many tissues in which cell division occurs essentially continuously. Examples of such tissues include nearly all tissues other than adult brain and cardiac muscle tissues, and particularly include rapidly-growing and rapidly-replaced tissues such as epithelial and endothelial tissues. Elimination of abnormal or damaged cells from a tissue (other than adult brain or cardiac muscle tissues) frequently occurs by apoptosis of the abnormal or damaged cells, rather than by necrosis, which can lead to inflammation. Apoptosis thus represents an important homeostatic process in healthy individuals, and aberrance in normal apoptosis can lead to occurrence of one or more disorders. INTERCEPT 309 (which, as described above is similar to the rat protein of Briehl et al.) can also be associated with apoptosis. INTERCEPT 309 can modulate apoptosis in tissues in which it is expressed, both under normal (i.e., homeostatic, non-disorder-associated) conditions and in tissue affected by a disorder associated with aberrant apoptosis. Disorders associated with aberrant apoptosis include both disorders in which apoptosis occurs to a supra-normal degree (e.g., human immunodeficiency virus-mediated depletion of $CD4^+$ T cells) and disorders in which apoptosis is inhibited, relative to normal levels (e.g., various cancers and viral infections characterized by survival of virus-infected cells). Examples of disorders associated with aberrant apoptosis include substantially all cancers and viral infections, obesity, diabetes, atherosclerosis, arteriosclerosis, coronary artery disease, and angiogenesis. INTERCEPT 309 proteins, nucleic acids encoding them, and agents that modulate activity or expression of either of these can be used to prognosticate, diagnose, and treat one or more of these disorders.

MANGO 419

A cDNA clone (designated cohqf013f05) encoding at least a portion of human MANGO 419 protein was isolated from a human cDNA library prepared from prostate carcinoma tissue which had metastasized to liver. Human MANGO 419 protein is a secreted protein.

The full length of the cDNA encoding human MANGO 419 protein (SEQ ID NO: 141) is 323 nucleotide residues. The ORF of this cDNA, nucleotide residues 84 to 323 of SEQ ID NO: 141 (i.e., SEQ ID NO: 142), encodes an 80-amino acid residue (or longer) protein (SEQ ID NO: 143), corresponding to a 56-residue (or longer) secreted mature protein.

The invention thus includes purified human MANGO 419 protein, both in the form of the immature 80 amino acid residue protein (SEQ ID NO: 143) and in the form of the mature 56 amino acid residue protein (SEQ ID NO: 145). Mature human MANGO 419 proteins can be synthesized without the signal sequence polypeptide at the amino terminus thereof, or they can be synthesized by generating immature MANGO 419 protein and cleaving the signal sequence therefrom.

MANGO 419 protein can have one or more amino acid residues attached at the carboxyl terminal end thereof. By way of example, there can be from 1 to about 500, 1 to 100, 1 to 50, 1 to 30, 1 to 20, or 1 to 10 additional amino acid residues.

The invention includes nucleic acid molecules which encode a polypeptide of the invention. Such nucleic acids include, for example, a DNA molecule having the nucleotide sequence listed in SEQ ID NO: 141, such as the portion which encodes mature MANGO 419 protein, immature MANGO 419 protein, or a domain of MANGO 419 protein. These nucleic acids are collectively referred to as nucleic acids of the invention.

MANGO 419 proteins and nucleic acid molecules encoding them comprise a family of molecules having certain conserved structural and functional features.

A common domain present in MANGO 419 proteins is a signal sequence. In one embodiment, a MANGO 419 protein contains a signal sequence corresponding to the portion of the protein from amino acid residue 1 to about amino acid residue 24 of SEQ ID NO: 143 (SEQ ID NO: 144). It is recognized that the carboxyl terminal boundary of the signal sequence can be located one or two residues from the residue identified above (i.e., following residues 22, 23, 24, 25, or 26 of SEQ ID NO: 143). The signal sequence is cleaved during processing of the mature protein.

MANGO 419 proteins typically comprise a variety of potential post-translational modification sites and protein domains (often positioned within an extracellular or protein surface domain), such as those described herein in Table VII, as predicted by computerized sequence analysis of MANGO 419 proteins using amino acid sequence comparison software (comparing the amino acid sequence of MANGO 419 with the information in the PROSITE database {rel. 12.2; February 1995} and the Hidden Markov Models database {Rel. PFAM 3.3}).

TABLE VII

| Type of Potential Modification Site or Domain | Amino Acid Residues of SEQ ID NO: 143 | Amino Acid Sequence |
|---|---|---|
| Casein kinase II phosphorylation site | 31 to 34 | TFGE |
|  | 55 to 58 | SSDD |
| N-myristoylation site | 43 to 48 | GCRRCC |

In various embodiments, the protein of the invention has at least 1, 2, or all 3 of the post-translational modification sites and domains described herein in Table VII.

The signal peptide prediction program SIGNALP (Nielsen et al. (1997) Protein Engineering 10:1-6) predicted that human MANGO 419 protein includes an approximately 24 amino acid residue signal peptide (amino acid residues 1 to about 24 of SEQ ID NO: 143; SEQ ID NO: 144) preceding the mature MANGO 419 protein (amino acid residues 25 to 80 of SEQ ID NO: 143; SEQ ID NO: 145).

FIG. 18 depicts a hydrophobicity plot of human MANGO 419 protein. Relatively hydrophobic regions are above the dashed horizontal line, and relatively hydrophilic regions are below the dashed horizontal line. The hydrophobic region which corresponds to amino acid residues 1 to about 24 of SEQ ID NO: 143 is the signal sequence of human MANGO 419 (SEQ ID NO: 144). As described elsewhere herein, relatively hydrophilic regions are generally located at or near the surface of a protein, and are more frequently effective immunogenic epitopes than are relatively hydrophobic regions. For example, the region of human MANGO 419 protein from about amino acid residue 35 to about amino acid residue 55 appears to be located at or near the surface of the protein, while the region from about amino acid residue 60 to about amino acid residue 65 appears not to be located at or near the surface.

The predicted molecular weight of human MANGO 419 protein without modification and prior to cleavage of the signal sequence is about 8.8 kilodaltons. The predicted molecular weight of the mature human MANGO 419 protein without modification and after cleavage of the signal sequence is about 6.2 kilodaltons.

Expressed sequence tags (ESTs) which exhibit homology with SEQ ID NO: 141 have been isolated from murine mammary and embryonic tissues. Those ESTs have sequences that are similar to the sequence of a nucleic acid encoding an inner ear-specific collagen precursor.

Uses of MANGO 419 Nucleic Acids, Polypeptides, and Modulators Thereof

MANGO 419 proteins are involved in disorders which affect both tissues in which they are normally expressed and tissues in which they are normally not expressed. Based on the observations that cDNA corresponding to MANGO 419 occurs in a human metastatic prostate carcinoma cDNA library, and that ESTs obtained from mammary and embryonic tissues exhibit homology with MANGO 419 cDNA, it is evident that MANGO 419 protein can be involved in one or more biological processes which occur in these tissues. In particular, MANGO 419 can be involved in modulating growth, proliferation, survival, differentiation, and activity of cells of these tissues (e.g., mammary, prostate, and other epithelial and endothelial cells). MANGO 419 can have a role in disorders which affect epithelial and endothelial tissues including, for example, prostate, breast, and embryonic tissues. MANGO 419 proteins, nucleic acids encoding them, and small molecules which interact with either of these can be used to prognosticate, diagnose, and treat disorders of epithelial and endothelial tissues, particularly including carcinogenesis and metastasis of epithelial and endothelial neoplasms, such as prostate and mammary cancers.

Recovery of a cDNA encoding MANGO 419 from a library prepared using metastatic prostate carcinoma cells also indicates that MANGO 419 can affect the ability and propensity of a cell to adhere with other cells or with extracellular surfaces, and that MANGO 419 can affect the ability of cells which express it to move through other tissues and through extracellular matrix. Furthermore, the fact that MANGO 419 is a secreted protein indicates that it can be used (e.g., by detecting it in a body fluid) as a marker for the metastatic state of cancers, particularly including epithelial carcinomas.

Expression of MANGO 419 protein in epithelial tissues such as prostate and mammary tissues is an indication that MANGO 419 protein and nucleic acids which encode them can be involved in disorders of epithelial and endothelial tissues. Examples of disorders of epithelial and endothelial tissues include cell binding, adhesion, and proliferation disorders and epithelial/endothelial permeability-related disorders. MANGO 419 protein is involved in disorders associated with aberrant binding or adhesion of cells with other cells, with extracellular matrix, or with foreign materials. Disorders involving aberrant binding or adhesion of cells with other cells include both disorders in which cells normally bind with one another (e.g., metastasis of a cancerous cells away from a solid tissue site at which they normally occur or immune hypersensitivity) and disorders in which the cells do not normally bind with one another, but do bind with one another in individuals afflicted with the disorder (e.g., autoimmune disorders, infections, wherein cells with which T cells bind are not normally present in the animal, or disorders associated with abnormal blood coagulation). Disorders involving aberrant binding or adhesion of cells with extracellular matrix include those (e.g., metastasis of a normally solid tumor tissue away from it site of origin) in which the cells normally do, but aberrantly do not, bind with extracellular matrix as well as those (e.g., metastasis of tumor cells into a tissue in which the cells do not normally occur, autoimmune disorders, liver fibrosis, abnormal blood coagulation, atherosclerosis, and arteriosclerosis) in which the cells normally do not bind with extracellular matrix, but aberrantly do. Examples of disorders involving aberrant binding or adhesion of cells with foreign materials include those (e.g., allergies and hypersensitivity disorders such as latex hypersensitivity) associated with aberrant binding with the foreign material and disorders in which the cells normally bind with the foreign material, but aberrantly do not. MANGO 419 proteins, nucleic acids encoding them, and agents that modulate activity or expression of either of these can be used to prognosticate, diagnose, and treat one or more of these disorders.

Expression of MANGO 419 protein in epithelial tissues such as prostate and mammary tissues is an indication that MANGO 419 proteins and nucleic acids can be involved in disorders associated with aberrant permeability of epithelial tissues (i.e., aberrant permeability with regard to water, solutes, proteins, immune cells, and pathogens). Such disorders include, by way of example, kidney disorders, liver disorders, gastrointestinal disorders, endocrine and exocrine disorders, prostate disorders, gynecological disorders, skin disorders, and brain disorders. Examples of disorders of these types are described separately, for convenience, in the following paragraphs a)-h).

a) Kidney disorders with which MANGO 419 proteins and nucleic acids encoding them can be involved include the kidney disorders described elsewhere in this disclosure. MANGO 419 proteins, nucleic acids encoding them, and agents that modulate activity or expression of either of these can be used to prognosticate, diagnose, and treat one or more of these disorders.

b) Examples of liver disorders in which MANGO 419 can have a role include the liver disorders described elsewhere in this disclosure. MANGO 419 proteins, nucleic acids encoding them, and agents that modulate activity or expression of either of these can be used to prognosticate, diagnose, and treat one or more of these disorders.

c) Disorders of the gastrointestinal tract in which MANGO 419 can have a role include, for example, gastroesophageal reflux disease, gastric ulcers, gastritis, appendicitis, peritonitis, diarrhea, constipation, gastroenteritis, malabsorption syndromes such as celiac disease and tropical sprue, inflammatory bowel diseases such as Crohn's disease and ulcerative colitis, antibiotic-associated colitis, functional bowel disorders such as irritable bowel syndrome and functional diarrhea, diverticular diseases such as diverticulosis and diverticulitis, and benign and malignant neoplasms of the colon. MANGO 419 proteins, nucleic acids encoding them, and agents that modulate activity or expression of either of these can be used to prognosticate, diagnose, and treat one or more of these disorders.

d) Examples of endocrine and exocrine disorders with which MANGO 419 proteins and nucleic acids encoding them can be involved include diabetes mellitus, hypoglycemia, glucagon disorders, pituitary disorders such as diabetes insipidus, thyroid disorders such as hyper- and hypothyroidism, adrenal disorders such as Cushing's syndrome and hyperaldosteronism, multiple endocrine neoplasias, polyglandular deficiency syndromes, epithelial breast cancers, biliary calculi, cholecystitis, and neoplasms of the bile ducts, chronic and acute renal failure, immunologically mediated renal diseases, glomerular diseases such as acute nephritic syndrome and nephrotic syndrome, tubulointerstitial diseases, nephrotoxic disorders, and infections of the kidney, goiter, thyroiditis, thyroid cancers, and autoimmune diseases involving endocrine (e.g., thyroid) autoantigens. MANGO 419 proteins, nucleic acids encoding them, and agents that modulate activity or expression of either of these can be used to prognosticate, diagnose, and treat one or more of these disorders.

e) Prostate disorders with which MANGO 419 proteins and nucleic acids encoding them can be involved include prostate neoplasms, benign prostatic hyperplasia, and benign prostatic hypertrophy. MANGO 419 proteins, nucleic acids encoding them, and agents that modulate activity or expression of either of these can be used to prognosticate, diagnose, and treat one or more of these disorders.

f) Gynecological disorders in which MANGO 419 can have a role include ovarian, cervical, vulvar, and vaginal cancers, infertility, and endometriosis. MANGO 419 proteins, nucleic acids encoding them, and agents that modulate activity or expression of either of these can be used to prognosticate, diagnose, and treat one or more of these disorders.

g) Skin disorders with which MANGO 419 can be associated include psoriasis, infections, wounds (and healing of wounds), inflammation, dermatitis, acne, and benign and malignant dermatological tumors. MANGO-419 proteins, nucleic acids encoding them, and agents that modulate activity or expression of either of these can be used to prognosticate, diagnose, and treat one or more of these disorders.

h) Examples of brain disorders in which MANGO 419 can have a role include the brain disorders described elsewhere in this disclosure. MANGO 419 proteins, nucleic acids encoding them, and agents that modulate activity or expression of either of these can be used to prognosticate, diagnose, and treat one or more of these disorders.

INTERCEPT 429

A cDNA clone (designated jchrd012h06) encoding at least a portion of human INTERCEPT 429 protein was isolated from a human heart cDNA library.

Human INTERCEPT 429 protein is a transmembrane protein.

The full length of the cDNA encoding human INTERCEPT 429 protein (SEQ ID NO: 151) is 546 nucleotide residues. The ORF of this cDNA, nucleotide residues 95 to 439 of SEQ ID NO: 151 (i.e., SEQ ID NO: 152), encodes a 115-amino acid residue protein (SEQ ID NO: 153), corresponding to a 93-residue transmembrane mature protein.

The invention includes purified human INTERCEPT 429 protein, both in the form of the immature 115 amino acid residue protein (SEQ ID NO: 153) and in the form of the mature 93 amino acid residue protein (SEQ ID NO: 155). Mature human INTERCEPT 429 proteins can be synthesized without the signal sequence polypeptide at the amino terminus thereof, or they can be synthesized by generating immature INTERCEPT 429 protein and cleaving the signal sequence therefrom.

The invention includes nucleic acid molecules which encode a polypeptide of the invention. Such nucleic acids include, for example, a DNA molecule having the nucleotide sequence listed in SEQ ID NO: 151, such as the portion which encodes mature INTERCEPT 429 protein, immature INTERCEPT 429 protein, or a domain of INTERCEPT 429 protein. These nucleic acids are collectively referred to as nucleic acids of the invention.

INTERCEPT 429 proteins and nucleic acid molecules encoding them comprise a family of molecules having certain conserved structural and functional features.

A common domain present in INTERCEPT 429 proteins is a signal sequence.

In one embodiment, an INTERCEPT 429 protein contains a signal sequence corresponding to the portion of the protein from amino acid residue 1 to about amino acid residue 22 of SEQ ID NO: 153 (SEQ ID NO: 154). It is recognized that the carboxyl terminal boundary of the signal sequence can be located one or two residues from the residue identified above (i.e., following residues 20, 21, 22, 23, or 24 of SEQ ID NO: 153). The signal sequence is cleaved during processing of the mature protein.

INTERCEPT 429 proteins include two transmembrane domains, a pair of extra-membrane domains that flank the cell membrane on the same side of the membrane, and another extra-membrane domain that flanks the cell membrane on the opposite side of the membrane. The two transmembrane domains correspond to about amino acid residues 32 to 49 and 59 to 82 of SEQ ID NO: 153 (i.e., the transmembrane domains having the sequences SEQ ID NOs: 157 and 159). The pair of extra-membrane domains corresponds to about amino acid residues 23 to 31 and 83 to 115 of SEQ ID NO: 153 (these domains having the sequences SEQ ID NOs: 156 and 160). The other extra-membrane domain corresponds to about amino acid residues 50 to 58 of SEQ ID NO: 153 (this domain having the sequence SEQ ID NO: 158). In one embodiment, the pair of extra-membrane domains (i.e., those having the sequences SEQ ID NOs: 156 and 160) are intracellular domains and the other domain is an extracellular domain. However, in an alternative form, the pair of extra-membrane domains are extracellular and the other domain is cytoplasmic.

INTERCEPT 429 proteins typically comprise a variety of potential post-translational modification sites and protein domains (often positioned within an extracellular or protein surface domain), such as those described herein in Table VIII, as predicted by computerized sequence analysis of INTERCEPT 429 proteins using amino acid sequence comparison software (comparing the amino acid sequence of INTERCEPT 429 with the information in the PROSITE database {rel. 122; February, 1995} and the Hidden Markov Models database {Rel. PFAM 3.3}).

TABLE VIII

| Type of Potential Modification Site or Domain | Amino Acid Residues of SEQ ID NO: 153 | Amino Acid Sequence |
|---|---|---|
| N-glycosylation site | 88 to 91 | NRSA |
| Casein kinase II phosphorylation site | 93 to 96 | TKCD |

In various embodiments, the protein of the invention has one or both of the post-translational modification sites and domains described herein in Table VIII.

FIG. 19 depicts a hydrophobicity plot of human INTERCEPT 429 protein. Relatively hydrophobic regions are above the dashed horizontal line, and relatively hydrophilic regions are below the dashed horizontal line. The hydrophobic region which corresponds to amino acid residues 1 to 22 of SEQ ID NO: 153 is the signal sequence of human INTERCEPT 429 (SEQ ID NO: 154). As described elsewhere herein, relatively hydrophilic regions are generally located at or near the surface of a protein, and are more frequently effective immunogenic epitopes than are relatively hydrophobic regions. For example, the region of human INTERCEPT 429 protein from about amino acid residue 85 to about amino acid residue 100 appears to be located at or near the surface of the protein.

The predicted molecular weight of human INTERCEPT 429 protein without modification and prior to cleavage of the signal sequence is about 13.4 kilodaltons. The predicted molecular weight of the mature human INTERCEPT 429 protein without modification and after cleavage of the signal sequence is about 10.8 kilodaltons.

Expressed sequence tags (ESTs) which exhibit homology with SEQ ID NO: 151 have been isolated from murine small intestine tissue and from pooled human fetal lung, testis, and B cell tissues.

Uses of INTERCEPT 429 Nucleic Acids, Polypeptides, and Modulators Thereof

INTERCEPT 429 proteins are involved in disorders which affect both tissues in which they are normally expressed and tissues in which they are normally not expressed. Based on the observations that cDNA corresponding to INTERCEPT 429 occurs in a human heart cDNA library, and that ESTs obtained from small intestine and one or more of fetal lung, testis, and B cell tissues exhibit homology with MANGO 419 cDNA, it is evident that INTERCEPT 429 protein can be involved in one or more biological processes which occur in these tissues. In particular, INTERCEPT 429 is involved in modulating growth, proliferation, survival, differentiation, and activity of cells of these tissues (e.g., cardiac muscle cells), both in normal (i.e., non-diseased) tissues and in tissues which are affected by one or more disorders. Examples of disorders with which INTERCEPT 429 protein can be associated are described in the following paragraphs.

Heart disorders with one or more of which INTERCEPT 429 proteins and nucleic acids can be involved include the cardiovascular disorders described elsewhere in this disclosure. INTERCEPT 429 proteins, nucleic acids encoding them, and agents that modulate activity or expression of either of these can be used to prognosticate, diagnose, and treat one or more of these disorders.

Muscular disorders in which INTERCEPT 429 proteins and nucleic acids can have a role include muscular dystrophies, myotonic myopathies, glycogen storage disorders and familial periodic paralysis. INTERCEPT 429 proteins, nucleic acids encoding them, and agents that modulate activity or expression of either of these can be used to prognosticate, diagnose, and treat one or more of these disorders.

Lung disorders with which INTERCEPT 429 proteins and nucleic acids can be associated include, by way of example, asthma, chronic and acute bronchitis, chronic airway obstructive disorders, pulmonary embolism, pneumonia, and genesis and metastasis of lung tumors. INTERCEPT 429 proteins, nucleic acids encoding them, and agents that modulate activity or expression of either of these can be used to prognosticate, diagnose, and treat one or more of these disorders.

Testicular disorders which can involve INTERCEPT 429 proteins and nucleic acids include, for example, epididymoorchitis, mumps orchitis, and genesis and metastasis of testicular cancers. INTERCEPT 429 proteins, nucleic acids encoding them, and agents that modulate activity or expression of either of these can be used to prognosticate, diagnose, and treat one or more of these disorders.

B cell disorders in which INTERCEPT 429 proteins and nucleic acids can be involved include leukemias, lymphomas, leukopenias, plasma cell dyscrasias, and splenomegaly. INTERCEPT 429 proteins, nucleic acids encoding them, and agents that modulate activity or expression of either of these can be used to prognosticate, diagnose, and treat one or more of these disorders.

TANGO 210

A cDNA clone (designated jthke034a06) encoding at least a portion of human TANGO 210 protein was isolated from a human fetal skin cDNA library. A corresponding murine cDNA clone (designated jtmMa065g07) was isolated from a long term bone marrow cDNA library. The 'long term' bone marrow cDNA library was made by reverse transcription of mRNA obtained from bone marrow cells which were cultured for a period (generally two weeks) prior to stimulating the cells using yeast hyphae and thereafter obtaining mRNA from the cells. Human TANGO 210 protein is predicted by structural analysis to be a secreted protein although, in an alternative form, human TANGO 210 protein has a transmembrane region located near its carboxyl terminal end. Murine TANGO 210 protein is a secreted protein.

The full length of the cDNA encoding human TANGO 210 protein (SEQ ID NO: 171) is 1684 nucleotide residues. The open reading frame (ORF) of this cDNA, nucleotide residues 45 to 1583 of SEQ ID NO: 171 (i.e., SEQ ID NO: 172), encodes a 513-amino acid residue protein (FIG. 15; SEQ ID NO: 173), corresponding to a 496-residue secreted protein.

The invention thus includes purified human TANGO 210 protein, both in the form of the immature 513 amino acid residue protein (SEQ ID NO: 173) and in the form of the mature 496 amino acid residue protein (SEQ ID NO: 175). Mature human TANGO 210 protein can be in its secreted or membrane-bound form, as described below. The invention also includes purified murine TANGO 210 protein, both in the form of the immature 511-amino acid residue protein (SEQ ID NO: 183) and in the form of the mature 494-amino acid residue protein (SEQ ID NO: 185). Mature human or murine TANGO 210 proteins can be synthesized without the signal sequence polypeptide at the amino terminus thereof, or they can be synthesized by generating immature TANGO 210 protein and cleaving the signal sequence therefrom.

The invention includes nucleic acid molecules which encode a polypeptide of the invention. Such nucleic acids include, for example, a DNA molecule having the nucleotide sequence listed in SEQ ID NO: 171 or some portion thereof or SEQ ID NO: 181 or some portion thereof, such as the portion which encodes mature human or murine TANGO 210 protein, immature human or murine TANGO 210 protein, or a domain of human or murine TANGO 210 protein. These nucleic acids are collectively referred to as nucleic acids of the invention.

TANGO 210 proteins and nucleic acid molecules encoding them comprise a family of molecules having certain conserved structural and functional features.

A common domain present in TANGO 210 proteins is a signal sequence. In one embodiment, a TANGO 210 protein contains a signal sequence corresponding to the portion of the protein from amino acid residue 1 to about amino acid residue 17 of SEQ ID NO: 173 (SEQ ID NO: 174) or to the portion of the protein from amino acid residue 1 to about amino acid residue 17 of SEQ ID NO: 183 (SEQ ID NO: 184). It is recognized that the carboxyl terminal boundary of the signal sequence can be located one or two residues from the residue identified above (i.e., at residue 15, 16, 17, 18, or 19 of SEQ ID NO: 173 or at residue 15, 16, 17, 18, or 19 of SEQ ID NO: 183). The signal sequence is cleaved during processing of the mature protein.

TANGO 210 proteins can also include an extracellular domain. Murine TANGO 210 protein is secreted. However, in one alternative form, the human TANGO 210 protein is a transmembrane protein having an extracellular domain located from about amino acid residue 25 to amino acid residue 488 of SEQ ID NO: 173 (i.e., SEQ ID NO: 178). In this alternative form, human TANGO 210 protein also has a transmembrane region (i.e., about amino acid residues 489 to 506 of SEQ ID NO: 173; SEQ ID NO: 179) and an intracellular domain (i.e., about amino acid residues 507 to 513 of SEQ ID NO: 173; SEQ ID NO: 180). In another alternative form, human TANGO 210 protein has an intracellular domain located from about amino acid residue 25 to amino acid residue 488 of SEQ ID NO: 173 (i.e., SEQ ID NO: 178), a transmembrane region (i.e., about amino acid residues 489 to 506 of SEQ ID NO: 173; SEQ ID NO: 179), and an extracellular domain (i.e., about amino acid residues 507 to 513 of SEQ ID NO: 173; SEQ ID NO: 180).

TANGO 210 proteins typically comprise a variety of potential post-translational modification sites (often within an extracellular domain), domains, or both, such as those described herein in Tables IX (for human TANGO 210) and X (for murine TANGO 210), as predicted by computerized sequence analysis of TANGO 210 proteins using amino acid sequence comparison software (comparing the amino acid sequence of TANGO 210 with the information in the PROSITE database {rel. 12.2; February 1995} and the Hidden Markov Models database {Rel. PFAM 3.3}).

TABLE IX

| Type of Potential Modification Site or Domain | Amino Acid Residues of SEQ ID NO: 173 | Amino Acid Sequence |
|---|---|---|
| N-glycosylation site | 55 to 58 | NRSL |
| | 110 to 113 | NLTY |
| | 200 to 203 | NWTK |
| | 452 to 455 | NITR |
| | 470 to 473 | NSSF |
| | 508 to 511 | NTSI |
| Protein kinase C phosphorylation site | 75 to 77 | TGK |
| | 88 to 90 | TPR |
| | 112 to 114 | TYR |
| | 290 to 292 | TFR |
| | 384 to 386 | TTR |
| | 422 to 424 | SIR |
| Casein kinase II phosphorylation site | 24 to 27 | TENE |
| | 57 to 60 | SLID |
| | 193 to 196 | THFD |
| | 249 to 252 | SQDD |
| | 311 to 314 | TDVE |
| N-myristoylation site | 71 to 76 | GLTVTG |
| | 205 to 210 | GAGFNL |
| | 223 to 228 | GLSHSN |
| Hemopexin domain signature | 318 to 333 | |
| Hemopexin domain | 285 to 327 | |
| | 329 to 371 | |
| | 376 to 423 | |
| | 425 to 465 | |
| Peptidase_M10 domain | 36 to 202 | |
| Neutral zinc metallopeptidase zinc-binding domain signature | 213 to 222 | |
| Matrix metalloprotease cysteine switch | 89 to 96 | PRCGVPDV |

TABLE X

| Type of Potential Modification Site or Domain | Amino Acid Residues of SEQ ID NO: 183 | Amino Acid Sequence |
|---|---|---|
| N-glycosylation site | 55 to 58 | NRSL |
| | 453 to 456 | NITQ |
| | 471 to 474 | NASF |
| | 475 to 478 | NVSV |
| cAMP- or cGMP-dependent protein kinase phosphorylation site | 107 to 110 | RKYS |
| | 493 to 496 | KRLS |
| Protein kinase C phosphorylation site | 75 to 77 | TGK |
| | 112 to 114 | TYR |
| | 268 to 270 | TTK |
| | 291 to 293 | TFR |
| | 336 to 338 | SPR |
| | 386 to 388 | TRK |
| | 477 to 479 | SVK |
| Casein kinase II phosphorylation site | 57 to 60 | SLFD |
| | 123 to 126 | TPAD |
| | 193 to 196 | THFD |
| | 250 to 253 | SQDD |
| | 336 to 339 | SPRD |

TABLE X-continued

| Type of Potential Modification Site or Domain | Amino Acid Residues of SEQ ID NO: 183 | Amino Acid Sequence |
|---|---|---|
| N-myristoylation site | 71 to 76 | GLTVTG |
| | 86 to 191 | GLGLGG |
| | 224 to 229 | GLSHSN |
| Hemopexin domain signature | 319 to 334 | |
| Hemopexin domain | 286 to 328 | |
| | 330 to 372 | |
| | 377 to 424 | |
| | 426 to 466 | |
| Zinc-binding metallopeptidase_M10 domain | 36 to 202 | |
| Neutral zinc metallopeptidase zinc-binding domain signature | 214 to 223 | |
| Matrix metalloproteinase cysteine switch | 89 to 96 | PRCGVPDV |

In various embodiments, the protein of the invention has at least 1, 2, 4, 6, 10, 15, or 20 or more of the post-translational modification sites described herein in Tables IX and X.

Examples of additional domains present in human and murine TANGO 210 protein include hemopexin domains and peptidase_M10 domains and signature sequences corresponding to hemopexin domains, zinc-binding domains, and matrix metalloproteinase (MMP) cysteine switches. In one embodiment, the protein of the invention has at least one domain or signature sequence that is at least 55%, preferably at least about 65%, more preferably at least about 75%, yet more preferably at least about 85%, and most preferably at least about 95% identical to one of the domains and signature sequences described herein in Tables IX and X. Preferably, the protein of the invention has at least one hemopexin domain, one peptidase_M10 domain, one hemopexin domain signature sequence, one zinc-binding domain signature sequence, and one MMP cysteine switch signature sequence.

Hemopexin domains derive their name from a portion of a protein designated hemopexin. Hemopexin is a serum glycoprotein that binds with heme and transports it to the liver. Hemopexin domains facilitate binding of the protein comprising the domain with a variety of molecules and other proteins. Besides hemopexin, hemopexin domains occur in MMPs and in vitronectin, a cell adhesion and factor (Hunt et al. (1987) Prot. Seq. Data Anal. 1:21-26; Stanley (1986) FEBS Lett. 199:249-253. A consensus hemopexin domain signature sequence has been identified (Pfam Accession PDOC00023), which has the structure (L, I, A, or T)-$X_3$—W—$X_{(2\ or\ 3)}$—(P or E)-$X_2$-(L, I, V, M, F, or Y)-(D, E, N, Q, or S)—(S, T, or A)-(A or V)-(L, I, V, M, F, or Y), (SEQ ID NO: 451)

wherein standard single-letter amino acid codes are used, X being any amino acid residue. Each of the human and murine TANGO 210 amino acid sequences include a single copy of this consensus sequence. This consensus sequence occurs in the amino acid sequences of many MMPs, including MMPs-1, -2, -3, -9, -10, -11, -12, -14, -15, and -16.

Peptidase_M 10 domains are conserved amino acid sequences which occur in type 10 zinc-dependent metalloproteinases, according to the classification of Rawlings et al. (1995, Meth. Enzymol 248:183-228). Several mammalian MMPs are type 10 zinc-dependent metalloproteinases including, for example, MMP-1 (interstitial collagenase), MMP-2 (72 kilodalton gelatinase), MMP-3 (stromelysin-1) MMP-7 (matrylisin), MMP-8 (neutrophil collagenase), MMP-9 (92 kilodalton gelatinase), and MMP-10 (stromelysin-2; Woessner, 1991, FASEB J. 5:2145-2154). The peptidase_M10 domain includes a consensus zinc-binding domain signature sequence having the structure (G, S, T, A, L, I, V, or N)—X$_2$—H-E-(L, I, V, M, F, Y, or W)-(D, E, G, H, R, K, or P)—H—X-(L, I, V, M, F, Y, W, G, S, P, or Q), (SEQ ID NO: 452)

wherein standard single-letter amino acid codes are used, X being any amino acid residue. The two histidine residues of the consensus sequence have been recognized as zinc ligands, and the glutamate residue is the (proteinase) active site residue. Each of the human and murine TANGO 210 amino acid sequences include this consensus sequence.

Another distinguishing characteristic of mammalian extracellular MMPs is presence in the amino acid sequence of the MMP of an MMP cysteine switch signature. The consensus MMP cysteine switch signature sequence has the structure P—R—C-(G or N)—X—P-(D or R)-(L, I, V, S, A, P, K, or Q) (SEQ ID NO: 453)

wherein standard single-letter amino acid codes are used, X being any amino acid residue. Each of the human and murine TANGO 210 amino acid sequences include a single copy of this consensus sequence. Human MMPs in which this consensus sequence occurs include MMPs-1, -2, -3, -7, -8, -9, -10, -11, -12, -13, -14, -15, and -16.

The signal peptide prediction program SIGNALP (Nielsen et al. (1997) Protein Engineering 10:1-6) predicted that human TANGO 210 protein includes an approximately 17 amino acid signal peptide (amino acid residues 1 to 15, 16, 17, 18, or 19 of SEQ ID NO: 173; SEQ ID NO: 174) preceding the mature, secreted TANGO 210 protein (amino acid residues 18 to 513 of SEQ ID NO: 173; SEQ ID NO: 175). In one alternative form, human TANGO 210 protein includes an extracellular domain (amino acid residues 18 to 488 of SEQ ID NO: 173; SEQ ID NO: 178), a transmembrane domain (amino acid residues 489 to 506 of SEQ ID NO: 173; SEQ ID NO: 179), and a cytoplasmic domain (amino acid residues 507 to 513 of SEQ ID NO: 173; SEQ ID NO: 180). In another alternative form, human TANGO 210 protein includes a cytoplasmic domain (amino acid residues 18 to 488 of SEQ ID NO: 173; SEQ ID NO: 178), a transmembrane domain (amino acid residues 489 to 506 of SEQ ID NO: 173; SEQ ID NO: 179), and an extracellular domain (amino acid residues 507 to 513 of SEQ ID NO: 173; SEQ ID NO: 180).

FIG. 20 depicts a hydrophobicity plot of human TANGO 210 protein.

Relatively hydrophobic regions are above the dashed horizontal line, and relatively hydrophilic regions are below the dashed horizontal line. The hydrophobic region which corresponds to amino acid residues 1 to about 17 of SEQ ID NO: 173 is the signal sequence of human TANGO 210 (SEQ ID NO: 174). The hydrophobic region which corresponds to amino acid residues 489 to 506 of SEQ ID NO: 173 is the transmembrane portion in the alternative form of human TANGO 210 protein. As described elsewhere herein, relatively hydrophilic regions are generally located at or near the surface of a protein, and are more frequently effective immunogenic epitopes than are relatively hydrophobic regions. For example, the region of human TANGO 210 protein from about amino acid residue 190 to about amino acid residue 205 appears to be located at or near the surface of the protein, while the region from about amino acid residue 145 to about amino acid residue 155 appears not to be located at or near the surface.

The predicted molecular weight of human TANGO 210 protein without modification and prior to cleavage of the signal sequence is about 59.0 kilodaltons. The predicted molecular weight of the mature human TANGO 210 protein without modification and after cleavage of the signal sequence is about 57.0 kilodaltons.

Northern hybridization experiments using human tissue samples indicated that mRNA corresponding to the cDNA encoding TANGO 210 is expressed in the tissues listed in Table XI, wherein "+" indicates detectable expression and "−" indicates failure to detect expression.

TABLE XI

| Animal | Tissue | Expression |
| --- | --- | --- |
| Human (Adult) | kidney | + |
| | heart | − |
| | brain | − |
| | placenta | − |
| | lung | − |
| | liver | − |
| | skeletal muscle | − |
| | pancreas | − |
| Human (Fetus) | kidney | + |

Human TANGO 210 exhibits sequence similarity to human MMP-8 (GENBANK™ Accession No. J05556), as indicated herein in FIGS. 24A-24B, which list an alignment of the amino acid sequences of these proteins. FIGS. 25A-25F depict an alignment of the nucleotide sequences of the ORFs of human TANGO 210 (SEQ ID NO: 172) and MMP-8 (SEQ ID NO: 176). In these alignments (each made using the ALIGN software; pam120.mat scoring matrix; gap penalties −12/−4), the amino acid and ORF nucleotide sequences corresponding to these two proteins are 43.9% identical and 57.1% identical, respectively.

The full length of the cDNA encoding murine TANGO 210 protein (SEQ ID NO: 181) is 2467 nucleotide residues. The ORF of this cDNA, nucleotide residues 22 to 927 and about 1280 to 1906 of SEQ ID NO: 181 (i.e., collectively, SEQ ID NO: 182), encodes a 510-amino acid residue protein (SEQ ID NO: 183). It is recognized that the precise locations of the intron boundaries in SEQ ID NO: 181 have not been identified. Thus, murine TANGO 210 protein can comprise one or more additional or one or more fewer amino acid residues at the exon-exon boundary (i.e., between about residues 302 and 303 of SEQ ID NO: 183).

The signal peptide prediction program SIGNALP (Nielsen et al. (1997) Protein Engineering 10:1-6) predicted that murine TANGO 210 protein includes an approximately 17 amino acid signal peptide (amino acid residues 1 to about 17 of SEQ ID NO: 183; SEQ ID NO: 184) preceding the mature TANGO 210 protein (amino acid residues 18 to 511 of SEQ ID NO: 183; SEQ ID NO: 185). Murine TANGO 210 protein is a secreted protein.

FIG. 2 depicts a hydrophobicity plot of murine TANGO 210 protein.

Relatively hydrophobic regions are above the dashed horizontal line, and relatively hydrophilic regions are below the dashed horizontal line. The hydrophobic region which corresponds to amino acid residues 1 to about 17 of SEQ ID NO: 183 is the signal sequence of murine TANGO 210 (SEQ ID NO: 184). As described elsewhere herein, relatively hydrophilic regions are generally located at or near the surface of a protein, and are more frequently effective immunogenic epitopes than are relatively hydrophobic regions. For example, the region of murine TANGO 210 protein from about amino acid residue 18 to about amino acid residue 28 appears to be located at or near the surface of the protein, while the region from about amino acid residue 148 to about amino acid residue 158 appears not to be located at or near the surface The predicted molecular weight of murine TANGO 210 protein without modification and prior to cleavage of the signal sequence is about 58.7 kilodaltons. The predicted molecular weight of the mature murine TANGO 210 protein without modification and after cleavage of the signal sequence is about 56.2 kilodaltons.

Human and murine TANGO 210 proteins exhibit considerable sequence similarity, as indicated herein in FIGS. 22A-22B. FIGS. 22A-22B depict an alignment of human and murine TANGO 210 amino acid sequences (SEQ ID NOs: 173 and 183, respectively). In this alignment (made using the ALIGN software {Myers and Miller (1989) CABIOS, ver. 2.0}; pam120.mat scoring matrix; gap penalties −12/−4), the proteins are 77.2% identical in the overlapping region (i.e., 393 identical residues out of 509 residues in the overlapping region, which includes amino acid residues 1-509 of SEQ ID NO: 173 and amino acid residues 1-509 of SEQ ID NO: 183). The human and murine cDNAs encoding TANGO 210 are 76.2% identical in the overlapping portions (i.e., nucleotide residues 29-1601 of SEQ ID NO: 171 and nucleotide residues 8-927 and 1280-1935 of SEQ ID NO: 181), as assessed using the same software and parameters and as indicated in FIGS. 15M through 15U. In the respective ORFs, SEQ ID NOs: 171 and 181 are 81.7% identical.

Human TANGO 210 Gene Expression Analysis

Expression of TANGO 210 in selected human tissues and cell types was analyzed as follows. Total RNA was prepared from selected human tissues using a single step extraction method using the RNA STAT-60™ kit according to the manufacturer's instructions (TelTest, Inc). Each RNA preparation was treated with DNase I (Ambion) at 37° C. for 1 hour. DNase I treatment was considered to be complete if the sample required at least 38 PCR amplification cycles to reach a threshold level of fluorescence using β-2 microglobulin as an internal amplicon reference. The integrity of the RNA samples following DNase I treatment was confirmed by agarose gel electrophoresis and ethidium bromide staining. Following phenol extraction, cDNA was prepared from the sample using the SUPERSCRIP™ Choice System following the manufacturer's instructions (Gibco BRL). A negative control of RNA without reverse transcriptase was mock reverse-transcribed for each RNA sample.

TANGO 210 expression was measured by TAQMAN® quantitative PCR (Perkin Elmer Applied Biosystems) in cDNA prepared from the following normal human tissues: prostate, liver, breast, skeletal muscle, brain, colon, heart, ovary, kidney, lung, vein, aorta, testis, thyroid, placenta, fetal liver, fetal heart, osteoblasts (undifferentiated), small intestine, spleen, thymus, and lymph node. Probes were designed by PRIMEREXPRESS™ software (PE Biosystems) based on the sequence of each gene.

Each gene probe was labeled using FAM (6-carboxyfluorescein), and the β2-microglobulin reference probe was labeled with a different fluorescent dye, VIC. The differential labeling of the target gene and internal reference gene thus enabled measurement in same well. Forward and reverse primers and the probes for both β2-microglobulin and target gene were added to the TAQMAN® Universal PCR Master Mix (PE Applied Biosystems). Although the final concentration of primer and probe varied, each was internally consistent within a given experiment. A typical experiment contained 200 nanomolar forward and reverse primers and 100 nanomolar probe for β-2 microglobulin, and 600 nanomolar forward and reverse primers and 200 nanomolar probe for the target gene. TAQMAN® matrix experiments were carried out using an ABI PRISM™ 7700 Sequence Detection System (PE Applied Biosystems). The thermal cycler conditions were as follows: hold for 2 minutes at 50° C. and 10 minutes at 95° C., followed by two-step PCR for 40 cycles of 95° C. for 15 seconds followed by 60° C. for 1 minute.

The following method was used to quantitatively calculate TANGO 210 gene expression in the selected tissues relative to β-2 microglobulin expression in the same tissue. The threshold cycle (Ct) value is defined as the cycle at which a statistically significant increase in fluorescence is detected. A lower Ct value is indicative of a higher mRNA concentration. The Ct value of the kinase gene is normalized by subtracting the Ct value of the β-2 microglobulin gene to obtain a ΔCt value using the following formula: $\Delta Ct = Ct_{kinase} - Ct_{\beta\text{-}2\ microglobulin}$. Expression is then calibrated against a cDNA sample showing a comparatively low level of expression of the kinase gene. The ΔCt value for the calibrator sample is then subtracted from ΔCt for each tissue sample according to the following formula: $\Delta\Delta Ct = \Delta Ct_{sample} - \Delta Ct_{calibrator}$. Relative expression is then calculated using the arithmetic formula given by $2^{-\Delta\Delta Ct}$. Expression of the target gene in each of the tissues tested is then graphically represented as discussed in more detail below.

FIG. 26 depicts expression of TANGO 210 in various tissues and cell lines as described above, relative to expression in fetal heart tissue. The results indicate significant expression in breast, skeletal muscle, colon, vein, aorta, testis, thyroid, and small intestine tissues.

Uses of TANGO 210 Nucleic Acids, Polypeptides, and Modulators Thereof

TANGO 210 proteins are involved in disorders which affect both tissues in which they are normally expressed and tissues in which they are normally not expressed. Based on the observations that cDNA corresponding to TANGO 210 occurs in a human fetal skin cDNA library and in a murine long term bone marrow cDNA library, and that RNA corresponding to TANGO 210 is detectable by Northern analysis of human adult and fetal kidney tissue, it is evident that TANGO 210 protein is involved in one or more biological processes which occur in these tissues. In particular, TANGO 210 is involved in modulating one or more of growth, proliferation, survival, differentiation, activity, morphology, and movement/migration of cells of these tissues. TANGO 210 is involved in modulating the structure of extracellular matrix which contacts or is in fluid communication with cells of these tissues. Thus, TANGO 210 has a role in disorders which affect these cells and one or more of their growth, proliferation, survival, differentiation, activity, morphology, and movement/migration, as well as the biological function of organs comprising one or more of these tissues.

The Northern analysis data described herein for human TANGO 210 indicate that nucleic acids corresponding to (i.e., homologous with or complementary to) all or part of human TANGO 210 cDNA or molecules (e.g., antibodies) which react specifically with human TANGO 210 protein or a portion thereof can be used to identify kidney tissue or to differentiate kidney tissue from other types of tissue, such as heart, brain, placenta, lung, liver, and pancreas tissues. Thus, human TANGO 210 proteins, nucleic acids, and compounds which interact specifically with either of these, can be used for one or more of tissue typing, identification, and separation.

TANGO 210 gene expression data described herein indicate that TANGO 210 can be expressed in at least breast, skeletal muscle, colon, vein, aorta, testis, thyroid, small intestine, and spleen tissues. Thus, TANGO 210 can have a role in disorders which affect cells of these tissues and one or more of their growth, proliferation, survival, differentiation, activity, morphology, and movement/migration, as well as the biological function of organs comprising one or more of these tissues.

The fact that TANGO 210 is expressed in breast tissue is an indication that TANGO 210 can be involved in both normal physiological function of breast tissue and in breast disorders. Examples of breast disorders include breast cancer, insufficient lactation, infant nutritional and growth disorders, mastalgia, fibroadenomas, breast infections, and gynecomastia.

In another example, TANGO 210 polypeptides, nucleic acids, and modulators thereof, can be involved in normal and aberrant functioning of skeletal muscle tissue, and can thus be involved in disorders of such tissue. Examples of skeletal muscle disorders include muscular dystrophy (e.g., Duchenne muscular dystrophy, Becker muscular dystrophy, Emery-Dreifuss muscular dystrophy, limb-girdle muscular dystrophy, facioscapulohumeral muscular dystrophy, myotonic dystrophy, oculopharyngeal muscular dystrophy, distal muscular dystrophy, and congenital muscular dystrophy), motor neuron diseases (e.g., amyotrophic lateral sclerosis, infantile progressive spinal muscular atrophy, intermediate spinal muscular atrophy, spinal bulbar muscular atrophy, and adult spinal muscular atrophy), myopathies (e.g., inflammatory myopathies (e.g., dermatomyositis and polymyositis), myotonia congenita, paramyotonia congenita, central core disease, nemaline myopathy, myotubular myopathy, and periodic paralysis), and metabolic diseases of muscle (e.g., phosphorylase deficiency, acid maltase deficiency, phosphofructokinase deficiency, de-brancher enzyme deficiency, mitochondrial myopathy, carnitine deficiency, carnitine palmityl transferase deficiency, phosphoglycerate kinase deficiency, phosphoglycerate mutase deficiency, lactate dehydrogenase deficiency, and myoadenylate deaminase deficiency). TANGO 210 polypeptides, nucleic acids, or modulators thereof can be used to prognosticate, diagnose, inhibit, prevent, or alleviate one or more of these disorders.

In another example, TANGO 210 polypeptides, nucleic acids, and modulators thereof can be used to treat colonic disorders, such as those described elsewhere in this disclosure.

In another example, TANGO 210 polypeptides, nucleic acids, and modulators thereof, can be used to treat cardiovascular disorders, such as those described elsewhere in this disclosure.

In another example, TANGO 210 polypeptides, nucleic acids, or modulators thereof, can be used to treat testicular disorders, such as those described elsewhere in this disclosure.

TANGO 210 polypeptides, nucleic acids, and modulators thereof, can be involved in disorders of the thyroid gland, such as hyperthyroidism (e.g., diffuse toxic hyperplasia, toxic multi-nodular goiter, toxic adenoma, and acute or sub-acute thyroiditis), hypothyroidism (e.g., cretinism and myxedema), thyroiditis (e.g., Hashimoto's thyroiditis, sub-acute granulomatous thyroiditis, sub-acute lymphocytic thyroiditis, Riedel's thryroiditis), Graves' disease, goiter (e.g., simple diffuse goiter and multi-nodular goiter), and tumors (e.g., adenoma, papillary carcinoma, follicular carcinoma, medullary carcinoma, undifferentiated malignant carcinoma, Hodgkin's disease, and non-Hodgkin's lymphoma). TANGO 210 polypeptides, nucleic acids, or modulators thereof can be used to prognosticate, diagnose, inhibit, prevent, or alleviate one or more of these disorders.

In another example, TANGO 210 polypeptides, nucleic acids, and modulators thereof can be used to treat intestinal disorders (e.g., disorders of the small intestine), such as ischemic bowel disease, infective enterocolitis, Crohn's disease, benign tumors, malignant tumors (e.g., argentaffinomas, lymphomas, adenocarcinomas, and sarcomas), malabsorption syndromes (e.g., celiac disease, tropical sprue, Whipple's disease, and abetalipoproteinemia), obstructive lesions, hernias, intestinal adhesions, intussusception, and volvulus.

TANGO 210 nucleic acids, proteins, and modulators thereof can be used to modulate proliferation, migration, morphology, differentiation, function, or some combination of these, of cells that form the spleen, (e.g., cells of the splenic connective tissue, splenic smooth muscle tells, or endothelial cells of the splenic blood vessels) or of blood cells that are processed (e.g., regenerated, matured, or phagocytized) within the spleen, as described elsewhere in this disclosure.

There are several indications that TANGO 210 is an MMP. For instance, presence of each of a Peptidase_M110 domain, a zinc-binding domain signature, a hemopexin domain signature, and a cysteine switch in the amino acid sequences of both human and murine TANGO 210 indicates that TANGO 210 exhibits extracellular matrix proteinase activity (e.g., collagenase and basement membrane degradative activities). In addition, homology between the sequence of human TANGO 210 and MMPs (e.g., MMP-8, as described herein) is a further indication the TANGO 210 is an MMP.

MMPs degrade extracellular matrix (ECM), and are thus involved in maintenance, and in renewal and replacement of old ECM with new ECM. ECM serves numerous purposes in the body, including providing support, containment, or both, to specialized tissues (e.g., tissues of organs such as skin, kidney, bone marrow, etc.) and regulating fluid balance in tissues which line a void or fluid-filled compartment (e.g., skin, bladder, kidney, stomach, etc.). Demonstration, as described herein, that TANGO 210 is expressed in several of these tissues (fetal skin, bone marrow, kidney) indicates that TANGO 210 is involved in one or more of these processes.

An important function of kidney tissue is to regulate the volume and composition of body fluids. The kidneys regulate body fluids by selectively permitting water, electrolytes, metabolites, and the like to pass from the plasma into the bladder in a regulatable manner while retaining cells and proteins in the plasma. By regulating fluid balance, the kidneys also exert a significant effect on arterial blood pressure. The kidneys perform these functions in a manner analogous to filtration.

Fluid outflow from the plasma occurs through the membranes of kidney glomerular capillaries in structures designated Bowman's capsules. The membrane of glomerular capillaries has three layers (normal capillaries have only two). Glomerular capillaries have a highly fenestrated luminal endothelium which can serve to prevent passage of cells through the capillary membrane, but do not substantially inhibit passage of serum proteins. Surrounding the endothelium is an ECM basement membrane comprising collagen and peptidoglycan. An epithelial layer having gaps or channels through which glomerular filtrate is passed surrounds the basement membrane.

The basement membrane is the layer of the glomerular capillary membrane which is principally responsible for retention of serum proteins. In order to maintain proper operation of the kidneys, it is critical that the relative porosity of the basement membrane be maintained. Mineral precipitates, circulating bacteria, and the like can clog the pores of the basement membrane. Turnover, renewal, or controlled degradation of the basement membrane ensures that the basement membrane remains functional. TANGO 210 is involved in regulating the thickness, porosity, and rate of degradation of the basement membrane of glomerular capillaries and other ECM components of kidney tissue. TANGO 210 is therefore involved in normal and abnormal formation and maintenance of functional kidney tissue. Thus, TANGO 210 is involved in a number of disorders which relate to aberrant kidney tissue formation and function. Such disorders include the kidney disorders described elsewhere herein. TANGO 210 proteins, nucleic acids encoding them, and agents that modulate activity or expression of either of these can be used to prognosticate, diagnose, treat, and inhibit one or more of these disorders.

Recovery of a cDNA encoding TANGO 210 from a murine long term bone marrow cDNA library indicates that TANGO 210 is expressed in bone marrow, and is thus involved both in normal physiological processes which occur in bone marrow and in disorders which affect bone marrow. ECM is a significant component of bone marrow, and TANGO 210 is involved in degradation of ECM associated with turnover/renewal of bone marrow tissue, and with changes which occur in the bone marrow with age. As mammals age, the bone marrow becomes increasingly gelatinous and the ECM composition of the marrow changes. The cellular content of the bone marrow changes with time as well. In young mammals, most bones are filled with red marrow, which comprises large numbers of hematopoietic cells. As mammals age, red marrow is replaced by gelatinous, adipose cell-containing white and yellow marrows. TANGO 210 is involved in ECM changes which accompany age related changes in marrow composition. TANGO 210 is also involved in bone marrow-related disorders such as bone marrow failure (e.g., that associated with anemia) and rejection of heterologous implanted bone marrow. TANGO 210 proteins, nucleic acids encoding them, and agents that modulate activity or expression of either of these can be used to prognosticate, diagnose, treat, and inhibit one or more of these disorders. In addition, because TANGO 210 is associated with remodeling of bone marrow, TANGO 210 is also capable of modulating acceptance of donor bone marrow in a recipient.

Recovery of a cDNA encoding TANGO 210 from a human fetal skin cDNA library indicates that TANGO 210 is expressed in human skin, and is involved both in normal physiological processes which occur in skin and in skin disorders. Skin is a multi-layered tissue in which the various tissue layers can have different ECM compositions. Skin has a variety of roles in the normal mammal. Skin maintains the mechanical, osmotic, chemical, photic, and thermal integrity of the exterior surface of the mammal. TANGO 210, being expressed in the skin and able to modulate ECM composition, is therefore involved in regulating these characteristics in normal individuals and in individuals afflicted with disorders relating to aberrant regulation of these characteristics (e.g., ichthyosis). TANGO 210 is also involved in other disorders which occur in or affect ECM in skin. Such disorders include, by way of example, psoriasis, infections, wounds (and healing of wounds), inflammation, dermatitis, acne, benign and malignant dermatological tumors, and the like. TANGO 210 proteins, nucleic acids encoding them, and agents that modulate activity or expression of either of these can be used to prognosticate, diagnose, treat, and inhibit one or more of these disorders.

Numerous cancers are associated with aberrant MMP expression and activity. MMPs can aid cancer growth and metastasis by degrading ECM, thereby providing an avenue for angiogenesis, cell growth, or cell movement through a tissue. TANGO 210 is able to modulate the rate and extent of angiogenesis, and is therefore useful for prognosticating, diagnosing, treating, and inhibiting one or more disorders associated with aberrant angiogenesis, including, but not limited to cancers. Disorders associated with aberrant angiogenesis include both those associated with an abnormally high rate or extent of angiogenesis (e.g., cancerous growth and metastasis) and those associated with an abnormally or insufficiently low rate or extent of angiogenesis (e.g., impaired wound healing, transplanted tissue rejection, and acute and chronic ischemic disorders such as stroke). TANGO 210 proteins, nucleic acids encoding them, and agents that modulate activity or expression of either of these can be used to prognosticate, diagnose, treat, and inhibit one or more cancers or other disorders associated with aberrant angiogenesis.

TANGO 366

A cDNA clone (designated jthqc016c02) encoding at least a portion of human TANGO 366 protein was isolated from a human normal prostate fibroblast cDNA library by SPOT analysis. Human TANGO 366 protein is predicted by structural analysis to be a transmembrane protein.

The full length of the cDNA encoding human TANGO 366 protein (SEQ ID NO: 191) is 2628 nucleotide residues. The ORF of this cDNA, nucleotide residues 86 to 1144 of SEQ ID NO: 191 (i.e., SEQ ID NO: 192), encodes a 353-amino acid residue protein (SEQ ID NO: 193), corresponding to a 337-residue transmembrane protein.

The invention thus includes purified human TANGO 366 protein, both in the form of the immature 353 amino acid residue protein (SEQ ID NO: 193) and in the form of the mature 337 amino acid residue protein (SEQ ID NO: 195). Mature human TANGO 366 proteins can be synthesized without the signal sequence polypeptide at the amino terminus thereof, or it can be synthesized by generating immature TANGO 366 protein and cleaving the signal sequence therefrom.

The invention includes nucleic acid molecules which encode a polypeptide of the invention. Such nucleic acids include, for example, a DNA molecule having the nucleotide sequence listed in SEQ ID NO: 191 or some portion thereof, such as the portion which encodes mature human TANGO 366 protein, immature human TANGO 366 protein, or a domain of human TANGO 366 protein. These nucleic acids are collectively referred to as nucleic acids of the invention.

TANGO 366 proteins and nucleic acid molecules encoding them comprise a family of molecules having certain conserved structural and functional features.

A common domain present in TANGO 366 proteins is a signal sequence. In one embodiment, a TANGO 366 protein contains a signal sequence corresponding to the portion of the protein from amino acid residue 1 to about amino acid residue 16 of SEQ ID NO: 193 (SEQ ID NO: 194). It is recognized that the carboxyl terminal boundary of the signal sequence can be located one or two residues from the residue identified above (i.e., at residue 14, 15, 16, 17, or 18 of SEQ ID NO: 193). The signal sequence is cleaved during processing of the mature protein.

TANGO 366 proteins can include an extracellular domain. The human TANGO 366 protein extracellular domain is located from about amino acid residue 17 to amino acid residue 216 of SEQ ID NO: 193 (i.e., the extracellular domain has the sequence SEQ ID NO: 196).

In addition, TANGO 366 can include a transmembrane domain. In one embodiment, a TANGO 366 protein of the invention contains a transmembrane domain corresponding to about amino acid residues 217 to 239 of SEQ ID NO: 193 (i.e., the transmembrane domain has the sequence SEQ ID NO: 197).

The present invention includes TANGO 366 proteins having a cytoplasmic domain, particularly including proteins having a carboxyl-terminal cytoplasmic domain. The human TANGO 366 cytoplasmic domain is located from about amino acid residue 240 to amino acid residue 353 of SEQ ID NO: 193 (i.e., the cytoplasmic domain has the sequence SEQ ID NO: 198).

In an alternative embodiment, TANGO 366 proteins can have a cytoplasmic domain located from about amino acid residue 17 to amino acid residue 216 of SEQ ID NO: 193 (i.e., the cytoplasmic domain has the sequence SEQ ID NO: 196); a transmembrane domain corresponding to about amino acid residues 217 to 239 of SEQ ID NO: 193 (i.e., the transmembrane domain has the sequence SEQ ID NO: 197); and an extracellular domain located from about amino acid residue 240 to amino acid residue 353 of SEQ ID NO: 193 (i.e., the extracellular domain has the sequence SEQ ID NO: 198)

TANGO 366 proteins typically comprise a variety of potential post-translational modification sites (often within an extracellular domain), such as those described herein in Table XII, as predicted by computerized sequence analysis of TANGO 366 proteins using amino acid sequence comparison software (comparing the amino acid sequence of TANGO 366 with the information in the PROSITE database {rel. 12.2; February 1995} and the Hidden Markov Models database {Rel. PFAM 3.3}).

TABLE XII

| Type of Potential Modification Site or Domain | Amino Acid Residues of SEQ ID NO: 193 | Amino Acid Sequence |
|---|---|---|
| N-glycosylation site | 74 to 77 | NESV |
|  | 137 to 140 | NLSH |
| Protein kinase C phosphorylation site | 16 to 18 | TTR |
|  | 67 to 69 | SNR |
|  | 332 to 334 | SPK |
| Casein kinase II phosphorylation site | 40 to 43 | TRVD |
|  | 280 to 283 | SLQE |
| Tyrosine kinase phosphorylation site | 318 to 325 | RLVREGTY |
| N-myristoylation site | 13 to 18 | GAQTTR |
|  | 32 to 37 | GLFDSF |
|  | 88 to 93 | GLDLSH |
|  | 214 to 219 | GNPLAV |
|  | 223 to 228 | GAFAGL |
| Glycosaminoglycan attachment site | 45 to 48 | SGLG |
| Leucine rich repeat amino terminal (LRRNT) domain | 19 to 58 |  |
| Leucine rich repeat (LRR) domain | 59 to 82 |  |
|  | 85 to 108 |  |
|  | 109 to 132 |  |
|  | 133 to 155 |  |
|  | 185 to 206 |  |
|  | 207 to 229 |  |
|  | 230 to 254 |  |
|  | 255 to 279 |  |
|  | 280 to 303 |  |
| Leucine zipper pattern | 284 to 305 |  |

In various embodiments, the protein of the invention has at least 1, 2, 4, 6, 10, 15, or 20 or more of the post-translational modification sites described herein in Table XII.

Examples of additional domains present in human TANGO 366 protein include a glycosaminoglycan attachment site, several leucine rich repeat (LRR and LRRNT) domains, and a leucine zipper domain. In one embodiment, the protein of the invention has at least one domain that is at least 55%, preferably at least about 65%, more preferably at least about 75%, yet more preferably at least about 85%, and most preferably at least about 95% identical to one of the LRR or leucine zipper domains described herein in Table XII. Preferably, the protein of the invention has at least one LRR domain, one leucine zipper domain, and one potential glycosaminoglycan attachment site sequence.

One or more LRR domains are present in a variety of proteins involved in protein-protein interactions. Such proteins include, for example, proteins involved in signal transduction, cell-to-cell adhesion, cell-to-extracellular matrix adhesion, cell development, DNA repair, RNA processing, and cellular molecular recognition processes. Specialized LRR domains, designated LRR amino terminal (LRRNT) domains often occur near the amino ends of a series of LRR domains. TANGO 366 protein has nine LRR domains, arranged in two groups, the first group including (from the amino terminus toward the carboxyl terminus of TANGO 366) the LRRNT domain and four LRR domains, and the second group including four LRR domains.

TANGO 366 is involved in one or more physiological processes in which these other LRR domain-containing proteins are involved, namely binding of cells with extracellular proteins such as soluble extracellular proteins and cell surface proteins of other cells.

TANGO 366 comprises a leucine zipper region at about amino acid residue 284 to about amino acid residue 305 (i.e., 284 LdlsgtnLvplpeaLllhlpaL 305; SEQ ID NO: 458). Leucine zipper regions are known to be involved in dimerization of proteins. Leucine zipper regions interact with one another, leading to formation of homo- or hetero-dimers between proteins, depending on their identity. Dimers of proteins having leucine zipper regions can also interact with DNA. The presence in TANGO 366 of a leucine zipper region is a further indication that this protein is involved in protein-protein interactions.

The signal peptide prediction program SIGNALP (Nielsen et al. (1997) Protein Engineering 10:1-6) predicted that human TANGO 366 protein includes an approximately 16 amino acid signal peptide (amino acid residues 1 to about 16 of SEQ ID NO: 193; SEQ ID NO: 194) preceding the mature TANGO 366 protein (amino acid residues 17 to 353 of SEQ ID NO: 193; SEQ ID NO: 195). Human TANGO 366 protein includes an extracellular domain (amino acid residues 17 to 216 of SEQ ID NO: 193; SEQ ID NO: 196), a transmembrane domain (amino acid residues 217 to 239 of SEQ ID NO: 193; SEQ ID NO: 197), and a cytoplasmic domain (amino acid residues 240 to 353 of SEQ ID NO: 193; SEQ ID NO: 198).

FIG. 27 depicts a hydrophobicity plot of human TANGO 366 protein. Relatively hydrophobic regions are above the dashed horizontal line, and relatively hydrophilic regions are below the dashed horizontal line. The hydrophobic region which corresponds to amino acid residues 1 to about 16 of SEQ ID NO: 193 is the signal sequence of human TANGO 366 (SEQ ID NO: 194), and the hydrophobic region which corresponds to amino acid residues 217 to 239 of SEQ ID NO: 193 is the transmembrane region of TANGO 366 (SEQ ID NO: 197). As described elsewhere herein, relatively hydrophilic regions are generally located at or near the surface of a protein, and are more frequently effective immunogenic epitopes than are relatively hydrophobic regions. For example, the region of human TANGO 366 protein from about amino acid residue 315 to about amino acid residue 330 appears to be located at or near the surface of the protein, while the region from about amino acid residue 290 to about amino acid residue 305 appears not to be located at or near the surface.

The predicted molecular weight of human TANGO 366 protein without modification and prior to cleavage of the signal sequence is about 37.8 kilodaltons. The predicted molecular weight of the mature human TANGO 366 protein without modification and after cleavage of the signal sequence is about 36.1 kilodaltons.

TANGO 366 exhibits limited sequence similarity to numerous cell surface proteins, including proteins which serve as cell surface antigens, proteoglycans, and protein receptors. TANGO 366 protein, cDNA, and ORF exhibit sequence homology to the sequences corresponding to a GENBANK™ record having Accession No. HSM800846. The nucleotide sequence of the DNA molecule described in GENBANK™ Accession No. HSM800846 is identical to nucleotide residues 418 to 2628 of SEQ ID NO: 191. The cDNA of GENBANK™ Accession No. HSM800846 was obtained from uterine tissue, indicating that TANGO 366 is expressed in uterine tissue and thus involved in normal and aberrant physiological processes in uterine tissue. In addition, nucleotide residues 36 to 319 of the reverse complement of SEQ ID NO: 191 exhibits significant homology with expressed sequence tag (EST) 01904, which is disclosed in an international patent application having PCT Publication No. WO93/16178. The ESTs described in that application were isolated from human brain tissue. This is an indication that TANGO 366 is expressed in brain tissue and thus is involved in normal and aberrant physiological processes in brain tissue.

Uses of TANGO 366 Nucleic Acids,
Polypeptides, and Modulators Thereof

TANGO 366 proteins are involved in disorders which affect both tissues in which they are normally expressed and tissues in which they are normally not expressed. Based on the observations that cDNA corresponding to TANGO 366 occurs in a human normal prostate fibroblast, brain, and uterus cDNA libraries, it is evident that TANGO 366 protein is involved in one or more biological processes which occur in prostate, brain, uterus, and other solid tissues. In particular, TANGO 366 is involved in modulating one or more of growth, proliferation, survival, differentiation, activity, morphology, and movement/migration of cells of prostate, brain, uterus, and other solid tissues. Thus, TANGO 366 has a role in disorders which affect the prostate, brain, uterus, and other solid tissues and one or more of growth, proliferation, survival, differentiation, activity, morphology, and movement/migration of cells in those tissues, as well as the biological function of organs (e.g., the prostate) comprising such tissues.

Disorders which affect the prostate include the prostate disorders described elsewhere in this disclosure. TANGO 366 proteins, nucleic acids encoding them, and agents that modulate activity or expression of either of these can be used to prognosticate, diagnose, treat, and inhibit one or more of these disorders.

Examples of brain disorders include the brain disorders described elsewhere in this disclosure. TANGO 366 proteins, nucleic acids encoding them, and agents that modulate activity or expression of either of these can be used to prognosticate, diagnose, treat, and inhibit one or more of these disorders.

Disorders which involve uterus tissue include the uterine disorders described elsewhere in this disclosure. TANGO 366 proteins, nucleic acids encoding them, and agents that modulate activity or expression of either of these can be used to prognosticate, diagnose, treat, and inhibit one or more of these disorders.

There are several indications that TANGO 366 is a cell surface protein which is involved in binding a protein to the cell which expresses TANGO 366. For instance, presence in TANGO 366 of an amino terminal extracellular domain that includes an LRRNT and four LRR domains exemplifies the cell-surface protein interaction capability of TANGO 366. In addition, the amino acid sequence similarity which TANGO 366 exhibits with respect to several other cell surface protein-binding proteins reinforces this view. TANGO 366 is involved in binding an animal cell which expresses it with one or more of an extracellular fluid protein, a protein component of the extracellular matrix, a surface protein another cell of the same animal, and a surface protein of a bacterium, fungus, or virus. Thus, TANGO 366 is involved in modulating cell-to-cell adhesion, tissue and extracellular matrix invasivity of cells, infectivity of cells by pathogens (e.g., bacteria and viruses), endocrine signaling processes, tissue developmental and organizational processes, and the like. TANGO 366 is involved in disorders in which these physiological processes are relevant. Such disorders include, for example, loss of control of cell growth, tumor metastasis, malformation of neurological connections, inflammation, immune and autoimmune responses, bacterial, fungal, and viral infections, and the like. TANGO 366 proteins, nucleic acids encoding them, and agents that modulate activity or expression of either of these can be used to prognosticate, diagnose, treat, and inhibit one or more of these disorders.

INTERCEPT 394

A cDNA clone (designated jthKa041 fo2) encoding at least a portion of human INTERCEPT 394 protein was isolated from a human fetal kidney cDNA library. Human INTERCEPT 394 protein is predicted by structural analysis to be a transmembrane protein.

The full length of the cDNA encoding human INTERCEPT 394 protein (SEQ ID NO: 201) is 3743 nucleotide residues. The ORF of this cDNA, nucleotide residues 320 to 2653 of SEQ ID NO: 201 (i.e., SEQ ID NO: 202), encodes a 778-amino acid residue protein (SEQ ID NO: 203), corresponding to a 778-residue transmembrane protein. It is recognized that, in an alternative form, transcription of INTERCEPT 394 protein can be initiated at the ATG codon located at nucleotide residues 120-122 of SEQ ID NO 201. In this alternative form, INTERCEPT 394 protein has, at the amino-terminal end of SEQ ID NO: 203, an additional 61 amino acid residues, this additional portion having the amino acid sequence encoded by nucleotide residues 120-319 of SEQ ID NO: 201. In the following discussion, molecules of the two forms of INTERCEPT 394 are referred to individually and collectively as molecules of the corresponding type (e.g., cDNA or protein).

The invention thus includes purified human INTERCEPT 394 protein, both in the form of the immature 778 amino acid residue protein (SEQ ID NO: 203) and in the form of the mature 753 amino acid residue protein (SEQ ID NO: 205). Mature human INTERCEPT 394 proteins can be synthesized without the signal sequence polypeptide at the amino terminus thereof, or it can be synthesized by generating immature INTERCEPT 394 protein and cleaving the signal sequence therefrom.

The invention includes nucleic acid molecules which encode a polypeptide of the invention. Such nucleic acids include, for example, a DNA molecule having the nucleotide sequence listed in SEQ ID NO: 201 or some portion thereof, such as the portion which encodes mature human INTERCEPT 394 protein, immature human INTERCEPT 394 protein, or a domain of human INTERCEPT 394 protein. These nucleic acids are collectively referred to as nucleic acids of the invention.

INTERCEPT 394 proteins and nucleic acid molecules encoding them comprise a family of molecules having certain conserved structural and functional features.

A common domain present in INTERCEPT 394 proteins is a signal sequence.

In one embodiment, a INTERCEPT 394 protein contains a signal sequence corresponding to the portion of the protein from amino acid residue 1 to about amino acid residue 25 of SEQ ID NO: 203 (SEQ ID NO: 204). It is recognized that the carboxyl terminal boundary of the signal sequence can be located one or two residues from the residue identified above (i.e., at residue 23, 24, 25, 26, or 27 of SEQ ID NO: 203). The signal sequence is cleaved during processing of the mature protein.

INTERCEPT 394 proteins can include an extracellular domain. Human INTERCEPT 394 protein extracellular domains are located at about amino acid residues 88 to 228 and 337 to 345 of SEQ ID NO: 203 (i.e., the extracellular domains having the sequences SEQ ID NOs: 208 and 212, respectively).

In addition, INTERCEPT 394 can include a transmembrane domain. In one embodiment, a INTERCEPT 394 protein of the invention contains transmembrane domains corresponding to about amino acid residues 71 to 87, 229 to 253, 320 to 336, and 346 to 364 of SEQ ID NO: 203 (i.e., the transmembrane domains having the sequences SEQ ID NOs: 207, 209, 211, and 213, respectively).

The present invention includes INTERCEPT 394 proteins having a cytoplasmic domain. The INTERCEPT 394 cytoplasmic domains are located from about amino acid residue 26 to 70, 254 to 319, and 365 to 778 of SEQ ID NO: 203 (i.e., the cytoplasmic domains having the sequences SEQ ID NOs: 206, 210, and 214, respectively).

In an alternative form, INTERCEPT 394 proteins have cytoplasmic domains located at about amino acid residues 88 to 228 and 337 to 345 of SEQ ID NO: 203 (i.e., the cytoplasmic domains having the sequences SEQ ID NOs: 208 and 212, respectively); transmembrane domains corresponding to about amino acid residues 71 to 87, 229 to 253, 320 to 336, and 346 to 364 of SEQ ID NO: 203 (i.e., the transmembrane domains having the sequences SEQ ID NOs: 207, 209, 211, and 213, respectively); and extracellular domains located from about amino acid residue 26 to 70, 254 to 319, and 365 to 778 of SEQ ID NO: 203 (i.e., the extracellular domains having the sequences SEQ ID NOs: 206, 210, and 214, respectively).

INTERCEPT 394 proteins typically comprise a variety of potential post-translational modification sites (often within an extracellular domain), such as those described herein in Table XIII, as predicted by computerized sequence analysis of INTERCEPT 394 proteins using amino acid sequence comparison software (comparing the amino acid sequence of INTERCEPT 394 with the information in the PROSITE database {rel. 12.2; February 1995} and the Hidden Markov Models database {Rel. PFAM 3.3}).

TABLE XIII

| Type of Potential Modification Site or Domain | Amino Acid Residues of SEQ ID NO: 203 | Amino Acid Sequence |
| --- | --- | --- |
| N-glycosylation site | 38 to 41 | NHSL |
| | 68 to 71 | NGSL |
| | 163 to 166 | NKSL |
| | 446 to 449 | NFTV |
| cAMP-/cGMP-dependent protein kinase phosphorylation site | 671 to 674 | RRES |
| Protein kinase C phosphorylation site | 62 to 64 | SAR |
| | 129 to 131 | TQK |
| | 207 to 209 | SLK |
| | 226 to 228 | SNR |
| | 568 to 570 | SCR |
| | 604 to 606 | TGR |
| Casein kinase II phosphorylation site | 24 to 27 | SCVD |
| | 50 to 53 | TLPD |
| | 118 to 121 | TWQE |
| | 129 to 132 | TQKE |
| | 143 to 146 | TELD |
| | 254 to 257 | SYAE |
| | 334 to 337 | TIYD |
| | 400 to 403 | TRDE |
| | 552 to 555 | SESE |
| | 614 to 617 | SGVD |
| | 626 to 629 | SVWE |
| | 680 to 683 | SAPD |
| | 767 to 770 | SEDE |
| Tyrosine kinase phosphorylation site | 140 to 148 | RELTELDIY |
| N-myristoylation site | 69 to 74 | GSLITI |
| | 175 to 180 | GLGEAV |
| | 185 to 190 | GLKYNF |
| | 264 to 269 | GALGAR |
| | 319 to 324 | GAFFAG |
| | 354 to 359 | GVTVTV |
| | 453 to 458 | GVGDTC |
| | 477 to 482 | GQTEAS |
| | 527 to 532 | GAAASL |
| | 600 to 605 | GQAPTG |
| | 630 to 635 | GQLQSL |
| | 685 to 690 | GGEGAR |
| | 709 to 714 | GAPETT |
| | 752 to 757 | GQSASR |

In various embodiments, the protein of the invention has at least 1, 2, 4, 6, 10, 15, or 20 or more of the post-translational modification sites described herein in Table XIII.

The signal peptide prediction program SIGNALP (Nielsen et al. (1997) Protein Engineering 10:1-6) predicted that human INTERCEPT 394 protein includes an approximately 25 amino acid signal peptide (amino acid residues 1 to about 25 of SEQ ID NO: 203; SEQ ID NO: 204) preceding the mature INTERCEPT 394 protein (amino acid residues 26 to 778 of SEQ ID NO: 203; SEQ ID NO: 205). Human INTERCEPT 394 protein includes two extracellular domains (amino acid residues 88 to 228 and 337 to 345 of SEQ ID NO: 203; SEQ ID NOs: 208 and 212, respectively), four transmembrane domains (amino acid residues 71 to 87, 229 to 253, 320 to 336, and 346 to 364 of SEQ ID NO: 203; SEQ ID NOs: 207, 209, 211, and 213, respectively), and three cytoplasmic domains (amino acid residues 26 to 70, 254 to 319, and 365 to 778 of SEQ ID NO: 203; SEQ ID NOs: 206, 210, and 214, respectively).

FIG. 28 depicts a hydrophobicity plot of human INTERCEPT 394 protein.

Relatively hydrophobic regions are above the dashed horizontal line, and relatively hydrophilic regions are below the dashed horizontal line. The hydrophobic region which corresponds to amino acid residues 1 to about 25 of SEQ ID NO: 203 is the signal sequence of human INTERCEPT 394 (SEQ ID NO: 204). Hydrophobic regions which corresponding to amino acid residues 71 to 87, 229 to 253, 320 to 336, and 346 to 364 of SEQ ID NO: 203 are the transmembrane regions of INTERCEPT 394 (SEQ ID NOs: 207, 209, 211, and 213, respectively). As described elsewhere herein, relatively hydrophilic regions are generally located at or near the surface of a protein, and are more frequently effective immunogenic epitopes than are relatively hydrophobic regions. For example, the region of human INTERCEPT 394 protein from about amino acid residue 205 to about amino acid residue 225 appears to be located at or near the surface of the protein, while the region from about amino acid residue 410 to about amino acid residue 340 appears not to be located at or near the surface.

The predicted molecular weight of human INTERCEPT 394 protein without modification and prior to cleavage of the signal sequence is about 87.4 kilodaltons. The predicted molecular weight of the mature human INTERCEPT 394 protein without modification and after cleavage of the signal sequence is about 84.5 kilodaltons. Nucleotide residues 2944 to 3482 of the reverse complement of SEQ ID NO: 201 exhibits significant homology with EST clone BJ38, which is disclosed in an international patent application having PCT Publication No. WO98/45435. The ESTs described in that application were isolated from human tissues. This is an indication that INTERCEPT 394 is expressed in the same tissues as this EST clone and thus is involved in normal and aberrant physiological processes in these tissues.

Uses of INTERCEPT 394 Nucleic Acids,
Polypeptides, and Modulators Thereof

INTERCEPT 394 proteins are involved in disorders which affect both tissues in which they are normally expressed and tissues in which they are normally not expressed. Based on the observations that cDNA corresponding to INTERCEPT 394 occurs in a human fetal kidney cDNA library, it is evident that INTERCEPT 394 protein is involved in one or more biological processes which occur in kidney and other fetal and adult human tissues. In particular, INTERCEPT 394 is involved in modulating one or more of growth, proliferation, survival, differentiation, activity, morphology, and movement/migration of cells of kidney and other tissues. Thus, INTERCEPT 394 has a role in disorders which affect kidney and other tissues and one or more of growth, proliferation, survival, differentiation, activity, morphology, and movement/migration of cells in those tissues, as well as the biological function of organs (e.g., the kidneys) comprising such tissues. Examples of kidney disorders are described elsewhere in this disclosure.

The relatively large size of the carboxyl-terminal cytoplasmic domain of INTERCEPT 394 is an indication that INTERCEPT 394 protein is involved in modulation of one or more intracellular processes. The presence of extracellular domains indicates that the activity of INTERCEPT 394 can be modulated by binding thereto of ligands (i.e., either naturally-occurring ligands or non-naturally-occurring ligands such as pharmaceutical agents). Because INTERCEPT 394 protein is an integral membrane protein, it is capable of exerting its physiological effect either by itself or in combination with one or more other membrane proteins. INTERCEPT 394 is thus involved in either or both of generation of signals which can be transmitted either to another protein (or other molecule) on the same side of the membrane or to a protein (or other molecule) on the opposite side of the membrane the membrane. INTERCEPT 394 can transmit such signals by binding a ligand, whereby its conformation is altered such that the ability of INTERCEPT 394 to interact with another molecule (e.g., to catalyze a reaction involving the molecule or by binding with the molecule) is altered upon binding the ligand. Alternatively, INTERCEPT 394 can be altered by being post-translationally modified (e.g., phosphorylated, glycosylated, or myristoylated) such that the ability of INTERCEPT 394 to interact with another molecule is altered upon post-translational modification.

Involvement of INTERCEPT 394 in one or more signal transmission pathways is an indication that INTERCEPT 394 is involved in physiological pathways involving such transmission. Thus, INTERCEPT 394 is also involved in disorders which involve these signal transmission pathways. Examples of physiological pathways that involve signal transmission include cell nutrition and metabolism, cell proliferation, cell differentiation, apoptosis, chemotactic and chemokinetic activities, cell aggregation and attachment, cell movement, immune stimulation, hematopoiesis, metastasis, and the like. INTERCEPT 394 is thus involved in disorders relating to aberrant activity of one or more of these signal transmission pathways. Such disorders include, for example, carcinogenesis, tumor growth, tumor metastasis, angiogenesis, apoptosis, inappropriate blood coagulation (e.g., that involved in atherosclerosis, arteriosclerosis, and stroke), immune hypo- and hyper-stimulation, cell metabolism disorders (e.g., diabetes), endocrine disorders (e.g., hypo- and hyper-thyroidism), mineral import and export disorders (e.g., osteoporosis, kidney stone formation, and hemochromatosis), and the like.

Presence of INTERCEPT 394 in the membrane of cells in which it is expressed indicates that INTERCEPT 394 can be used as a diagnostic target for detection or imaging of such cells. Furthermore, a portion of INTERCEPT 394 (e.g., an extracellular domain) can be used to interfere with binding of a virus which normally binds with INTERCEPT 394, thereby inhibiting, reducing, or eliminating pathological effects associated with infection of a human by the virus.

INTERCEPT 400

A cDNA clone (designated jthkf014a09) encoding at least a portion of human INTERCEPT 400 protein was isolated from a human normal embryonic keratinocyte cDNA library. A corresponding murine cDNA clone (designated jtmba232b12) was isolated from a brain polysome cDNA library. Human and murine INTERCEPT 400 proteins are predicted by structural analysis to be transmembrane proteins.

The full length of the cDNA encoding human INTERCEPT 400 protein (SEQ ID NO: 221) is 2989 nucleotide residues. The open reading frame (ORF) of this cDNA, nucleotide residues 206 to 1000 of SEQ ID NO: 221 (i.e., SEQ ID NO: 222), encodes a 265-amino acid residue immature protein (FIG. 18; SEQ ID NO: 223), corresponding to a 219-residue transmembrane protein.

The invention thus includes purified human INTERCEPT 400 protein, both in the form of the immature 265 amino acid residue protein (SEQ ID NO: 223) and in the form of the mature 219 amino acid residue protein (SEQ ID NO: 225). The invention also includes purified murine INTERCEPT 400 protein, which is a 180-amino acid residue transmembrane protein (SEQ ID NO: 243). Mature human INTERCEPT 400 proteins can be synthesized without the signal sequence polypeptide at the amino terminus thereof, or it can be synthesized by generating immature INTERCEPT 400 protein and cleaving the signal sequence therefrom.

The invention includes nucleic acid molecules which encode a polypeptide of the invention. Such nucleic acids include, for example, a DNA molecule having the nucleotide sequence listed in SEQ ID NO: 221 or some portion thereof or SEQ ID NO: 241 or some portion thereof, such as the portion which encodes mature human or murine INTERCEPT 400 protein, immature human INTERCEPT 400 protein, or a domain of human or murine INTERCEPT 400 protein. These nucleic acids are collectively referred to as nucleic acids of the invention.

INTERCEPT 400 proteins and nucleic acid molecules encoding them comprise a family of molecules having certain conserved structural and functional features.

A common domain present in INTERCEPT 400 proteins is a signal sequence. In one embodiment, a INTERCEPT 400 protein contains a signal sequence corresponding to the portion of the protein from amino acid residue 1 to about amino acid residue 46 of SEQ ID NO: 223 (SEQ ID NO: 224). It is recognized that the carboxyl terminal boundary of the signal sequence can be located one or two residues from the residue identified above (i.e., at residue 44, 45, 46, 47, or 48 of SEQ ID NO: 223). The signal sequence is cleaved during processing of the mature protein.

INTERCEPT 400 proteins can also include an extracellular domain. Human INTERCEPT 400 protein includes extracellular domains located from about amino acid residues 47 to 62, 154 to 164, and 218 to 231 of SEQ ID NO: 223 (i.e., the extracellular domains having the amino acid sequences SEQ ID NOs: 226, 230, and 234, respectively). Murine INTERCEPT 400 protein includes extracellular domains located from about amino acid residues 61 to 71 and 125 to 140 of SEQ ID NO: 243 (i.e., these extracellular domains having the amino acid sequences SEQ ID NOs: 246 and 250, respectively).

In addition, INTERCEPT 400 can include a transmembrane domain. Human INTERCEPT 400 protein includes transmembrane domains corresponding to about amino acid residues 63 to 79, 137 to 153, 165 to 183, 194 to 217, and 232 to 251 of SEQ ID NO: 223 (i.e., the transmembrane domains having the sequences SEQ ID NOs: 227, 229, 231, 233, and 235, respectively). Murine INTERCEPT 400 protein includes transmembrane domains corresponding to about amino acid residues 44 to 60, 72 to 90, 101 to 124, and 141 to 160 of SEQ ID NO: 243 (i.e., the transmembrane domains having the sequences SEQ ID NOs: 245, 247, 249, and 251, respectively).

The present invention includes INTERCEPT 400 proteins having a cytoplasmic domain. Human INTERCEPT 400 cytoplasmic domains are located from about amino acid residue 80 to 136, 184 to 193, and 252 to 265 of SEQ ID NO: 223 (i.e., the cytoplasmic domains having the sequences SEQ ID NOs: 228, 232, and 236, respectively). Murine INTERCEPT 400 cytoplasmic domains are located from about amino acid residue 1 to 43, 91 to 100, and 161 to 174 of SEQ ID NO: 243 (i.e., the cytoplasmic domains having the sequences SEQ ID NOs: 244, 248, and 252, respectively).

It is recognized that, in one form, murine INTERCEPT 400 protein can include an amino terminal portion approximately 60-120 (likely 80-100) amino acid residues in length.

In an alternative embodiment, human INTERCEPT 400 proteins have cytoplasmic domains located from about amino acid residues 47 to 62, 154 to 164, and 218 to 231 of SEQ ID NO: 223 (i.e., the cytoplasmic domains having the amino acid sequences SEQ ID NOs: 226, 230, and 234, respectively); transmembrane domains corresponding to about amino acid residues 63 to 79, 137 to 153, 165 to 183, 194 to 217, and 232 to 251 of SEQ ID NO: 223 (i.e., the transmembrane domains having the sequences SEQ ID NOs: 227, 229, 231, 233, and 235, respectively); and extracellular domains are located from about amino acid residue 80 to 136, 184 to 193, and 252 to 265 of SEQ ID NO: 223 (i.e., the extracellular domains having the sequences SEQ ID NOs: 228, 232, and 236, respectively).

In an alternative embodiment, murine INTERCEPT 400 proteins have cytoplasmic domains located from about amino acid residues 61 to 71 and 125 to 140 of SEQ ID NO: 243 (i.e., these cytoplasmic domains having the amino acid sequences SEQ ID NOs: 246 and 250, respectively); transmembrane domains corresponding to about amino acid residues 44 to 60, 72 to 90, 101 to 124, and 141 to 160 of SEQ ID NO: 243 (i.e., the transmembrane domains having the sequences SEQ ID NOs: 245, 247, 249, and 254, respectively); and extracellular domains are located from about amino acid residue 1 to 43, 91 to 100, and 161 to 174 of SEQ ID NO: 243 (i.e., the extracellular domains having the sequences SEQ ID NOs: 244, 248, and 255, respectively).

INTERCEPT 400 proteins typically comprise a variety of potential post-translational modification sites (often within an extracellular domain), such as those described herein in Tables XIV (for human INTERCEPT 400) and XV (for murine INTERCEPT 400), as predicted by computerized sequence analysis of INTERCEPT 400 proteins using amino acid sequence comparison software (comparing the amino acid sequence of INTERCEPT 400 with the information in the PROSITE database {rel. 12.2; February 1995} and the Hidden Markov Models database {Rel. PFAM 3.3}).

TABLE XIV

| Type of Potential Modification Site or Domain | Amino Acid Residues of SEQ ID NO: 223 | Amino Acid Sequence |
|---|---|---|
| N-glycosylation site | 2 to 5 | NMSV |
| cAMP-/cGMP-dependent protein kinase phosphorylation site | 259 to 262 | RKTT |
| Protein kinase C phosphorylation site | 155 to 157 | SYK |
| | 191 to 193 | SRK |
| | 261 to 263 | TTK |
| Casein kinase II phosphorylation site | 7 to 10 | TLQE |
| | 97 to 100 | SVCD |
| | 155 to 158 | SYKD |
| | 262 to 265 | TKAE |
| N-myristoylation site | 77 to 82 | GALRTG |
| | 93 to 98 | GLKQSV |
| | 209 to 214 | GCVVNY |

TABLE XV

| Type of Potential Modification Site or Domain | Amino Acid Residues of SEQ ID NO: 243 | Amino Acid Sequence |
|---|---|---|
| cAMP-/cGMP-dependent protein kinase phosphorylation site | 168 to 171 | KKAT |
| Protein kinase C phosphorylation site | 62 to 64 | SYK |
| | 98 to 100 | SRK |
| Casein kinase II phosphorylation site | 4 to 7 | SVCD |
| | 62 to 65 | SYKD |
| | 171 to 174 | TKAE |
| N-myristoylation site | 116 to 121 | GCVINY |

In various embodiments, the protein of the invention has at least 1, 2, 4, 6, 10, 15, or 20 or more of the post-translational modification sites described herein in Tables XIV and XV.

The signal peptide prediction program SIGNALP (Nielsen et al. (1997) Protein Engineering 10: 1-6) predicted that human INTERCEPT 400 protein includes an approximately 46 amino acid signal peptide (amino acid residues 1 to about 46 of SEQ ID NO: 223; SEQ ID NO: 224) preceding the mature INTERCEPT 400 protein (amino acid residues 47 to 265 of SEQ ID NO: 223; SEQ ID NO: 225). Human INTERCEPT 400 protein includes three extracellular domains (amino acid residues 47 to 62, 154 to 164, and 218 to 231 of SEQ ID NO: 223; SEQ ID NOs: 226, 230, and 234, respectively), five transmembrane domains (amino acid residues 63 to 79, 137 to 153, 165 to 183, 194 to 217, and 232 to 251 of SEQ ID NO: 223; SEQ ID NOs: 227, 229, 231, 233, and 235, respectively), and three intracellular domains (amino acid residues 80 to 136, 184 to 193, and 252 to 265 of SEQ ID NO: 223; SEQ ID NOs: 228, 232, and 236, respectively).

FIG. 29 depicts a hydrophobicity plot of human INTERCEPT 400 protein. Relatively hydrophobic regions are above the dashed horizontal line, and relatively hydrophilic regions are below the dashed horizontal line. The hydrophobic region which corresponds to amino acid residues 1 to about 46 of SEQ ID NO: 223 is the signal sequence of human INTERCEPT 400 (SEQ ID NO: 224). As described elsewhere herein, relatively hydrophilic regions are generally located at or near the surface of a protein, and are more frequently effective immunogenic epitopes than are relatively hydrophobic regions. For example, the region of human INTERCEPT 400 protein from about amino acid residue 218 to about amino acid residue 231 appears to be located at or near the surface of the protein, while the region from about amino acid residue 80 to about amino acid residue 95 appears not to be located at or near the surface.

The predicted molecular weight of human INTERCEPT 400 protein without modification and prior to cleavage of the signal sequence is about 31.4 kilodaltons.

The predicted molecular weight of the mature human INTERCEPT 400 protein without modification and after cleavage of the signal sequence is about 25.8 kilodaltons.

Human INTERCEPT 400 exhibits sequence similarity to murine Cig30 protein (GENBANK™ Accession No. U97107), as indicated herein in FIG. 33, which lists an alignment (made using the ALIGN software; pam120.mat scoring matrix; gap penalties −12/−4) of the amino acid sequences of these proteins. FIGS. 34A-34C depict an alignment (also made using the ALIGN software; pam120.mat scoring matrix; gap penalties −12/−4) of the nucleotide sequences of the ORFs of human INTERCEPT 400 (SEQ ID NO: 222) and Cig30 (SEQ ID NO: 238). In these alignments (made using the ALIGN software; pam120.mat scoring matrix, gap penalties −12/−4), the amino acid sequences of these two proteins are 43.3% identical and the ORF nucleotide sequences corresponding to these two proteins are 56.8% identical. The cDNAs corresponding to these two proteins were found to be 48.4% identical using the LALIGN software (pam120.mat scoring matrix; gap penalties −12/−4).

The length of the incomplete cDNA encoding the carboxyl-terminal portion of murine INTERCEPT 400 protein (SEQ ID NO: 241) is 2032 nucleotide residues. The ORF of this cDNA, nucleotide residues 3 to 524 (SEQ ID NO: 242), encodes a protein comprising at least 180 amino acid residues (SEQ ID NO: 243). It is recognized that murine INTERCEPT 400 protein has about 60-120, more likely 80-100, additional amino acid residues at the amino terminal end thereof.

The signal peptide prediction program SIGNALP (Nielsen et al. (1997) Protein Engineering 10:1-6) predicted that the portion of murine INTERCEPT 400 protein described herein includes at least two extracellular domains (amino acid residues 61 to 71 and 125 to 140 of SEQ ID NO: 243; SEQ ID NOs: 246 and 250, respectively), at least four transmembrane domains (amino acid residues 44 to 60, 72 to 90, 101 to 124, and 141 to 160 of SEQ ID NO: 243; SEQ ID NOs: 245, 247, 249, and 254, respectively), and at least three cytoplasmic domains (amino acid residue 1 to 43, 91 to 100, and 161 to 174 of SEQ ID NO: 243; SEQ ID NOs: 244, 248, and 255, respectively).

FIG. 30 depicts a hydrophobicity plot of murine INTERCEPT 400 protein.

Relatively hydrophobic regions are above the dashed horizontal line, and relatively hydrophilic regions are below the dashed horizontal line. Hydrophobic regions corresponds to the identified transmembrane regions of murine INTERCEPT 400. As described elsewhere herein, relatively hydrophilic regions are generally located at or near the surface of a protein, and are more frequently effective immunogenic epitopes than are relatively hydrophobic regions. For example, the region from about amino acid residue 125 to about amino acid residue 140 appears to be located at or near the surface of the protein, while the region from about amino acid residue 14 to about amino acid residue 19 appears not to be located at or near the surface The predicted molecular weight of the portion of murine INTERCEPT 400 protein described herein is about 20.6 kilodaltons.

Human and murine INTERCEPT 400 proteins exhibit considerable sequence similarity, as indicated herein in FIGS. 31 and 32A-32C. FIG. 31 depicts an alignment of human and murine INTERCEPT 400 amino acid sequences (SEQ ID NOs: 223 and 243, respectively). In this alignment (made using the ALIGN software; pam120.mat scoring matrix; gap penalties −12/−4), the proteins are 94.8% identical in the overlapping region (i.e., 163 identical residues out of 172 residues in the overlapping region, which includes amino acid residues 94-265 of SEQ ID NO: 223 and amino acid residues 1-174 of SEQ ID NO: 243). The human and murine ORFs encoding INTERCEPT 400 are 92.8% identical in the overlapping portions (i.e., nucleotide residues 280-795 of SEQ ID NO: 222 and nucleotide residues 1-522 of SEQ ID NO: 242), as assessed using the same software and parameters and as indicated in FIGS. 32A-32C in an alignment made using the ALIGN software (pam120.mat scoring matrix; gap penalties −12/−4).

The partial nucleotide sequences of a rat cDNA clone (designated jtmba232b12; SEQ ID NO: 251) and ORF (SEQ ID NO: 252) encoding INTERCEPT 400 (SEQ ID NO: 253). An alignment (made using the ALIGN software; pam120.mat scoring matrix; gap penalties −12/−4) of human, murine and rat INTERCEPT 400 amino acid sequences is listed in FIG. 35.

Uses of INTERCEPT 400 Nucleic Acids,
Polypeptides, and Modulators Thereof

INTERCEPT 400 proteins are involved in disorders which affect both tissues in which they are normally expressed and tissues in which they are normally not expressed. Based on the observations that cDNA corresponding to INTERCEPT 400 occurs in a human normal embryonic keratinocyte cDNA library and in a murine brain polysome cDNA library, it is evident that INTERCEPT 400 protein is involved in one or more biological processes which occur in these tissues. In particular, INTERCEPT 400 is involved in modulating one or more of growth, proliferation, survival, differentiation, activity, morphology, and movement/migration of cells of these tissues. INTERCEPT 400 is involved in modulating the structure of extracellular matrix which contacts or is in fluid communication with cells of these tissues. Thus, INTERCEPT 400 has a role in disorders which affect these cells and one or more of their growth, proliferation, survival, differentiation, activity, morphology, and movement/migration, as well as the biological function of organs comprising one or more of these tissues.

Examples of brain disorders are described elsewhere in this disclosure. INTERCEPT 400 proteins, nucleic acids encoding them, and agents that modulate activity or expression of either of these can be used to prognosticate, diagnose, treat, and inhibit one or more of these disorders.

Examples of skin disorders with which INTERCEPT 400 can be associated are described elsewhere in this disclosure. INTERCEPT 400 proteins, nucleic acids encoding them, and agents that modulate activity or expression of either of these can be used to prognosticate, diagnose, treat, and inhibit one or more of these disorders.

Murine Cig30 protein, with which human INTERCEPT 400 shares significant amino acid sequence homology, is an integral membrane protein that is involved in recruitment and thermogenesis in brown adipose tissue in mice (Tvrdik et al., 1997, J.

Biol. Chem. 272:31738-31746). Yeast proteins which share significant homology with murine Cig30 and human, murine, and rat INTERCEPT 400 protein include proteins encoded by yeast genes SUR4 (APAI) and FENI (GNSI). These proteins are involved in phospholipid metabolism, sterol synthesis, budding, activation of glucose-regulated genes, glucose uptake, and glucan synthesis (Desfarges et al., 1993, Yeast 9:267-277; Silve et al., 1996, Mol. Cell. Biol. 16:2719-2727; Durrens et al., 1995, Curr. Genet. 27:213-216; Garcia-Arranz, 1994, J. Biol. Chem. 269:18076-18082; El-Sherbeini et al., 1995, J. Bacteriol. 177:3227-3234). These activities relate to remodeling of the plasma membrane and actin cytoskeleton in response to growth signals, most likely by modulating interaction between membrane phospholipids and the cytoskeleton. Thus, INTERCEPT 400 protein is involved in one or more of these activities, such as in immune stimulation, proliferation of leukocytes, generation and prolongation of an immune response, control of cellular metabolic processes, and the like.

INTERCEPT 400 is involved in generation, accumulation, and regulation of brown adipose tissue and other adipose tissues in humans, and is therefore involved in body temperature regulation, lipid metabolism, carbohydrate metabolism, body weight regulation, and the like. Thus, INTERCEPT 400 is implicated in disorders which relate to aberrance or imbalance in the normal physiological regulation of these processes. INTERCEPT 400 is also involved in disorders which relate to aberrant proliferation and growth of cells. Examples of disorders in which INTERCEPT 400 is involved include obesity, unusual susceptibility or insensitivity to heat or cold, diabetes, arteriosclerosis, atherosclerosis, cancer, hypo- and hyper-immune disorders (e.g., acquired immune deficiency syndrome and auto-immune disorders), immune proliferation, and the like. INTERCEPT 400 proteins, nucleic acids encoding them, and agents that modulate activity or expression of either of these can be used to prognosticate, diagnose, treat, and inhibit one or more of these disorders.

Chromosomal mapping data have been used to locate the gene encoding human INTERCEPT 400 at chromosome 4, between markers D4S1616 and D4S1611 (115.8-119.6 centimorgans). A form of iris hypoplasia associated with early onset glaucoma has been linked with this chromosomal region. Human INTERCEPT 400 allelic variants can include INTERCEPT 400 nucleotide sequence polymorphisms (e.g., nucleotide sequences that vary from SEQ ID NO: 221) that map to this chromosomal region.

INTERCEPT 217

A cDNA clone (designated jthqc035f08) encoding at least a portion of human INTERCEPT 217 protein was isolated from a human prostate cDNA library. The human INTERCEPT 217 protein is predicted by structural analysis to be a transmembrane protein. In addition, cDNA clones (including those designated jtmca047g07, jTmob373b05, and jambd078d12) encoding at least a portion of murine INTERCEPT 217 protein were isolated from murine cDNA libraries.

The full length of the cDNA encoding human INTERCEPT 217 protein (SEQ ID NO: 271) is 2895 nucleotide residues. The ORF of this cDNA, nucleotide residues 215 to 1579 of SEQ ID NO: 271 (i.e., SEQ ID NO: 272), encodes a 455-amino acid transmembrane protein (SEQ ID NO: 273). The murine ORF (SEQ ID NO: 362) comprises at least 962 nucleotide residues. The protein encoded by the murine ORF comprises at least 320 amino acid residues (i.e., SEQ ID NO: 363), and is also a transmembrane protein.

The invention also includes purified human INTERCEPT 217 protein, both in the form of the immature 455 amino acid residue protein (SEQ ID NO: 273) and in the form of the mature, approximately 435 amino acid residue protein (SEQ ID NO: 275). Mature human INTERCEPT 217 protein can be synthesized without the signal sequence polypeptide at the amino terminus thereof, or it can be synthesized by generating immature INTERCEPT 217 protein and cleaving the signal sequence therefrom.

The invention thus includes purified murine INTERCEPT 217 protein, both in the immature form comprising the 320 amino acid residues of SEQ ID NO: 363 and in the mature form comprising the approximately 305 carboxyl terminal amino acid residues of SEQ ID NO: 363 (i.e., comprising SEQ ID NO: 365). Mature murine INTERCEPT 217 protein can be synthesized without the signal sequence polypeptide at the amino terminus thereof, or it can be synthesized by generating immature INTERCEPT 217 protein and cleaving the signal sequence therefrom.

The invention includes nucleic acid molecules which encode an INTERCEPT 217 polypeptide of the invention. Such nucleic acids include, for example, a DNA molecule having the nucleotide sequence listed in SEQ ID NO: 271, in SEQ ID NO: 362 (i.e., the murine ORF), or in some portion of either of these, such as the portion which encodes mature human INTERCEPT 217 protein, immature human INTERCEPT 217 protein, or a domain of human INTERCEPT 217 protein. These nucleic acids are collectively referred to as INTERCEPT 217 nucleic acids of the invention.

INTERCEPT 217 proteins and nucleic acid molecules encoding them comprise a family of molecules having certain conserved structural and functional features. Each of these molecules is included in the invention.

A common domain present in INTERCEPT 217 proteins is a signal sequence. In one embodiment, a INTERCEPT 217 protein contains a signal sequence corresponding to about amino acid residues 1 to 20 of SEQ ID NO: 273 (SEQ ID NO: 274). The signal sequence is cleaved during processing of the mature protein.

INTERCEPT 217 proteins can include an extracellular domain. The human INTERCEPT 217 protein extracellular domain is located from about amino acid residue 21 to about amino acid residue 383 of SEQ ID NO: 273 (SEQ ID NO: 276). The murine INTERCEPT 217 protein extracellular domain is located from about amino acid residue 17 to about amino acid residue 213 of SEQ ID NO: 363 (SEQ ID NO: 366).

In addition, INTERCEPT 217 includes a transmembrane domain. As used herein, a "transmembrane domain" refers to an amino acid sequence which is at least about 20 to 25 amino acid residues in length and which contains at least about 65-70% hydrophobic amino acid residues such as alanine, leucine, phenylalanine, protein, tyrosine, tryptophan, or valine. In a preferred embodiment, a transmembrane domain contains at least about 15 to 30 amino acid residues, preferably about 20-25 amino acid residues, and has at least about 60-80%, more preferably 65-75%, and more preferably at least about 70% hydrophobic residues. Thus, in one embodiment, an INTERCEPT 217 protein of the invention contains a transmembrane domain corresponding to about amino acid residues 384 to 403 of SEQ ID NO: 273 (SEQ ID NO: 277) or to about amino acid residues 214 to 233 of SEQ ID NO: 363 (SEQ ID NO: 367).

The present invention includes INTERCEPT 217 proteins having a cytoplasmic domain, particularly including proteins having a carboxyl-terminal cytoplasmic domain. The human INTERCEPT 217 cytoplasmic domain is located from about amino acid residue 404 to amino acid residue 455 of SEQ ID NO: 273 (SEQ ID NO: 278). The murine INTERCEPT 217 cytoplasmic domain is located from about amino acid residue 234 to amino acid residue 320 of SEQ ID NO: 363 (SEQ ID NO: 368).

In one embodiment, the amino acid residues of human INTERCEPT 217 corresponding to SEQ ID NO: 278 are part of an extracellular domain, and the amino acid residues corresponding to SEQ ID NO: 276 are part of a cytoplasmic domain. In another embodiment, the amino acid residues of murine INTERCEPT 217 corresponding to SEQ ID NO: 368 are part of an extracellular domain, and the amino acid residues corresponding to SEQ ID NO: 366 are part of a cytoplasmic domain.

INTERCEPT 217 proteins typically comprise a variety of potential post-translational modification sites (often within an extracellular domain), such as those described herein in Tables XVIA (for human INTERCEPT 217) and XVIB (for murine INTERCEPT 217), as predicted by computerized sequence analysis of INTERCEPT 217 proteins using amino acid sequence comparison software (comparing the amino acid sequence of INTERCEPT 217 with the information in the PROSITE database {rel. 12.2; February 1995} and the Hidden Markov Models database {Rel. PFAM 3.3}). In certain embodiments, a protein of the invention has at least 1, 2, 4, 6, or 10 or more of the post-translational modification sites listed in Tables XVIA and XVIB.

TABLE XVIA

| Type of Potential Modification Site or Domain | Amino Acid Residues of SEQ ID NO: 273 | Amino Acid Sequence |
| --- | --- | --- |
| N-glycosylation site | 107 to 110 | NASG |
| | 272 to 275 | NCSS |
| | 301 to 304 | NTSV |
| | 362 to 365 | NQTH |
| | 368 to 371 | NVSV |
| Protein kinase C phosphorylation site | 120 to 122 | TLR |
| | 192 to 194 | SNR |
| | 295 to 297 | SLR |
| Casein kinase II phosphorylation site | 199 to 202 | SVPE |
| | 440 to 443 | TPPD |
| Tyrosine Kinase Phosphorylation Site | 282 to 289 | KRPEEHLY |
| N-myristoylation site | 8 to 13 | GTLLCM |
| | 19 to 24 | GTPDSE |
| | 103 to 108 | GVFVNA |
| | 179 to 184 | GLSATH |
| | 323 to 328 | GSRDGS |
| | 348 to 353 | GLFVCL |
| | 390 to 395 | GCAVGL |
| | 449 to 454 | GQASTS |
| Leucine zipper pattern | 45 to 66 | |
| Leucine rich repeat amino terminal domain (LLRNT) | 33 to 61 | |
| Leucine rich repeat (LRR) Domain | 62 to 85 | |
| | 86 to 109 | |
| | 110 to 133 | |
| | 134 to 157 | |
| | 158 to 181 | |
| | 184 to 207 | |
| Leucine rich repeat carboxyl terminal (LLRCT) domain | 219 to 274 | |

TABLE XVIB

| Type of Potential Modification Site or Domain | Amino Acid Residues of SEQ ID NO: 363 | Amino Acid Sequence |
| --- | --- | --- |
| N-glycosylation site | 102 to 105 | NCSV |
| | 131 to 134 | NTSV |
| | 192 to 195 | NQTL |
| | 198 to 201 | NVSV |
| cAMP-and cGMP-dependent protein kinase site | 280 to 283 | RKAS |
| Protein kinase C phosphorylation site | 125 to 127 | SLR |
| | 143 to 145 | SPK |
| | 279 to 281 | SRK |
| Casein kinase II phosphorylation site | 29 to 32 | SIPE |
| | 273 to 276 | TPPD |
| N-myristoylation site | 9 to 14 | GLGLTR |
| | 178 to 183 | GVFVCL |
| | 220 to 225 | GCIVGL |
| | 239 to 244 | GCCHCC |
| Amidation Site | 293 to 296 | PGKK |
| Immunoglobulin Domain | 14 to 37 | |
| Leucine rich repeat (LRR) Domain | 49 to 104 | |
| Leucine rich repeat carboxyl terminal (LLRCT) domain | 123 to 184 | |

Among the domains that occur in INTERCEPT 217 proteins are LRR domains, LRRNT domains, LRRCT domains, and immunoglobulin domains. In one embodiment, the protein of the invention has at least one domain that is at least 55%, preferably at least about 65%, more preferably at least about 75%, yet more preferably at least about 85%, and most preferably at least about 95% identical to one of these domains. In other embodiments, the protein has at least one of each of the LRR, LRRNT, and LRRCT domains described herein in Tables XVIA and XVIB. In other embodiments, the protein has at least one LRRNT domain, at least one LRRCT domain, and a plurality of (e.g., 2, 3, 4, or more) LRR domains.

One or more LRR domains are present in a variety of proteins involved in protein-protein interactions. Such proteins include, for example, proteins involved in signal transduction, cell-to-cell adhesion, cell-to-extracellular matrix adhesion, cell development, DNA repair, RNA processing, and cellular molecular recognition processes. Specialized LRR domains, designated LRR amino terminal (LRRNT) domains and LRR carboxyl terminal (LRRCT) domains often occur near the amino and carboxyl, respectively, ends of a series of LRR domains. Human INTERCEPT 217 protein has eight clustered LRR domains, including (from the amino terminus toward the carboxyl terminus of INTERCEPT 217) an LRRNT domain, six LRR domains, and an LRRCT domain.

The organization of LRR domains in human INTERCEPT 217 protein closely mirrors the organization of LRR domains in human platelet glycoprotein IB alpha chain precursor (GP-IBα), which also has eight clustered LRR domains from about amino acid residue 19 to about amino acid residue 281 thereof. The eight LRR domains of GP-IBα include an LRRNT domain at the end of the cluster nearest the amino terminus of GP-IBα and an LRRCT domain at the end of the cluster nearest the carboxyl terminus of GP-IBα. GP-IBα is a membrane-bound protein of human platelets that is involved in binding of von Willebrand's factor and in aggregation of platelets during thrombus formation. Thus, INTERCEPT 217 is involved in both normal and aberrant physiological activities involving blood clotting and thrombus formation. Examples of disorders involving such activities include, for example, stroke, embolism (e.g., cerebral, renal, and pulmonary emboli), hemophilia, restenotic injury, prosthesis-associated thrombogenesis, atherosclerosis, and arteriosclerosis.

INTERCEPT 217 is involved in one or more physiological processes in which these other LRR domain-containing proteins are involved, namely binding of cells with extracellular proteins such as soluble extracellular proteins and cell surface proteins of other cells.

Human INTERCEPT 217 comprises a leucine zipper region at about amino acid residue 45 to about amino acid residue 66 (i.e., 45 LsctglgLqdvpaeLpaa tadL 66; SEQ ID NO: 459). Leucine zipper regions are known to be involved in dimerization of proteins. Leucine zipper regions interact with one another, leading to formation of homo- or hetero-dimers between proteins, depending on their identity. The presence in INTERCEPT 217 of a leucine zipper region is a further indication that this protein is involved in protein-protein interactions.

The amino acid sequence of human INTERCEPT 217 protein includes multiple potential proline-rich Src homology 3 (SH3) domain binding sites in the cytoplasmic portion of the protein. SH3 domains mediate specific assembly of protein complexes, presumably by interacting with proline-rich protein domains (Morton and Campbell (1994) Curr. Biol. 4:615-617). SH3 domains also mediate interactions between proteins involved in transmembrane signal transduction. Coupling of proteins mediated by SH3 domains has been implicated in a variety of physiological systems, including those involving regulation of cell growth and proliferation, endocytosis, and activation of respiratory burst.

SH3 domains have been described in the art (e.g., Mayer et al. (1988) Nature 332:272-275; Musacchio et al. (1992) FEBS Lett. 307:55-61; Pawson and Schlessinger (1993) Curr. Biol. 3:434-442; Mayer and Baltimore (1993) Trends Cell Biol. 3:8-13; Pawson (1993) Nature 373:573-580), and occur in a variety of cytoplasmic proteins, including several (e.g., protein tyrosine kinases) involved in transmembrane signal transduction. Among the proteins in which one or more SH3 domains occur are protein tyrosine kinases such as those of the Src, Abl, Bkt, Csk and ZAP70 families, mammalian phosphatidylinositol-specific phospholipases C-gamma-1 and -2, mammalian phosphatidylinositol 3-kinase regulatory p85 subunit, mammalian Ras GTPase-activating protein (GAP), proteins which mediate binding of guanine nucleotide exchange factors and growth factor receptors (e.g., vertebrate GRB2, *Caenorhabditis elegans* sem-5, and Drosophila DRK proteins), mammalian Vav oncoprotein, guanidine nucleotide releasing factors of the CDC 25 family (e.g., yeast CDC25, yeast SCD25, and fission yeast ste6 proteins), MAGUK proteins (e.g., mammalian tight junction protein ZO-1, vertebrate erythrocyte membrane protein p55, *C. elegans* protein lin-2, rat protein CASK, and mammalian synaptic proteins SAP90/PSD-95, CHAPSYN-110/PSD-93, SAP97/DLG 1, and SAP102), proteins which interact with vertebrate receptor protein tyrosine kinases (e.g., mammalian cytoplasmic protein Nck and oncoprotein Crk), chicken Src substrate p80/85 protein (cortactin), human hemopoietic lineage cell specific protein Hs 1, mammalian dihydrouridine-sensitive L-type calcium channel beta subunit, human myasthenic syndrome antigen B (MSYB), mammalian neutrophil cytosolic activators of NADPH oxidase (e.g., p47 {NCF-1}, p67 {NCF-2}, and *C. elegans* protein B0303.7), myosin heavy chains (MY03) from amoebae, from slime molds, and from yeast, vertebrate and Drosophila spectrin and fodrin alpha chain proteins, human amphiphysin, yeast actin-binding proteins ABP 1 and SLA3, yeast protein BEM 1, fission yeast protein scd2 (ra13), yeast BEM1-binding proteins B012 (BEB1) and BOB1 (BOI1), yeast fusion protein FUS1, yeast protein RSV167, yeast protein SSU8-, yeast hypothetical proteins YAR014c, YFR024c, YHL002w, YHR016c, YJL020C, and YHR114w, hypothetical fission yeast protein SpAC12C2.05c, and *C. elegans* hypothetical protein F42H10.3. Of these proteins, multiple SH3 domains occur in vertebrate GRB2 protein, *C. elegans* sem-5 protein, Drosophila DRK protein, oncoprotein Crk, mammalian neutrophil cytosolic activators of NADPH oxidase p47 and p67, yeast protein BEMI, fission yeast protein scd2, yeast hypothetical protein YHR114w, mammalian cytoplasmic protein Nck, *C. elegans* neutrophil cytosolic activator of NADPH oxidase B0303.7, and yeast actin-binding protein SLA1. Of these proteins, three or more SH3 domains occur in mammalian cytoplasmic protein Nck, *C. elegans* neutrophil cytosolic activator of NADPH oxidase B0303.7, and yeast actin-binding protein SLA1. The presence of SH3 domain binding sites in INTERCEPT 217 indicates that INTERCEPT 217 interacts with one or more of these and other SH3 domain-containing proteins and is thus involved in physiological processes in which one or more of these or other SH3 domain-containing proteins are involved.

Human INTERCEPT 217 exhibits amino acid sequence similarity to porcine ribonuclease inhibitor, a protein which binds with high affinity to pancreatic ribonucleases and inhibits their activity. INTERCEPT 217 thus is involved with similar physiological processes in humans. An alignment of the amino acid sequences of human INTERCEPT 217 and porcine ribonuclease inhibitor protein (SwissProt Accession number P10775) is shown in FIG. 37A. In this alignment (made using the ALIGN software {Myers and Miller (1989) CABIOS, ver. 2.0}; pam120.mat scoring matrix; gap opening penalty=12, gap extension penalty=4), the proteins are 20.5% identical. An alignment of human (SEQ ID NO: 273) and murine INTERCEPT 217 amino acid sequences (SEQ ID NO: 363; made using BESTFIT software, BLOSUM62 scoring matrix, gap opening penalty=12, frameshift gap penalty=5, gap extension penalty=4). In this alignment, the human and murine amino acid sequences are 71.3% identical in the overlapping region. Alignment of human and murine INTERCEPT 217 ORFs indicated 79.9% nucleotide sequence identity in the overlapping region.

The signal peptide prediction program SIGNALP (Nielsen et al. (1997) Protein Engineering 10:1-6) predicted that human INTERCEPT 217 protein includes an approximately 20 (i.e., 18, 19, 20, 21, or 22) amino acid residue signal peptide (amino acid residues 1 to 20 of SEQ ID NO: 273; SEQ ID NO: 274) preceding the mature INTERCEPT 217 protein (i.e., approximately amino acid residues 21 to 455 of SEQ ID NO: 273; SEQ ID NO: 275). In one embodiment, human INTERCEPT 217 protein includes an extracellular domain (amino acid residues 21 to 383 of SEQ ID NO: 273; SEQ ID NO: 276); a transmembrane domain (amino acid residues 384 to 403 of SEQ ID NO: 273; SEQ ID NO: 277); and a cytoplasmic domain (amino acid residues 404 to 455 of SEQ ID NO: 273; SEQ ID NO: 278). In an alternative embodiment, human INTERCEPT 217 protein includes a cytoplasmic domain (amino acid residues 21 to 383 of SEQ ID NO: 273; SEQ ID NO: 276); a transmembrane domain (amino acid residues 384 to 403 of SEQ ID NO: 273; SEQ ID NO: 277); and an extracellular domain (amino acid residues 404 to 455 of SEQ ID NO: 273; SEQ ID NO: 278).

The SIGNALP program predicted that murine INTERCEPT 217 protein includes an approximately 15 (i.e., 13, 14, 15, 16, or 17) amino acid residue signal peptide (amino acid residues 1 to 16 of SEQ ID NO: 363; SEQ ID NO: 364) preceding the mature INTERCEPT 217 protein (i.e., approximately amino acid residues 16 to 320 of SEQ ID NO: 363;

SEQ ID NO: 365). In one embodiment, murine INTERCEPT 217 protein includes an extracellular domain (amino acid residues 16 to 213 of SEQ ID NO: 363; SEQ ID NO: 366); a transmembrane domain (amino acid residues 214 to 233 of SEQ ID NO: 363; SEQ ID NO: 367); and a cytoplasmic domain (amino acid residues 234 to 320 of SEQ ID NO: 363; SEQ ID NO: 368). In an alternative embodiment, murine INTERCEPT 217 protein includes a cytoplasmic domain (amino acid residues 16 to 213 of SEQ ID NO: 363; SEQ ID NO: 366); a transmembrane domain (amino acid residues 214 to 233 of SEQ ID NO: 363; SEQ ID NO: 367); and an extracellular domain (amino acid residues 234 to 320 of SEQ ID NO: 363; SEQ ID NO: 368).

FIG. 36 depicts a hydrophobicity plot of human INTERCEPT 217 protein. Relatively hydrophobic regions are above the dashed horizontal line, and relatively hydrophilic regions are below the dashed horizontal line. The hydrophobic region which corresponds to amino acid residues 1 to 20 of SEQ ID NO: 273 is the signal sequence of human INTERCEPT 217 (SEQ ID NO: 274). The hydrophobic region which corresponds to amino acid residues 384 to 403 of SEQ ID NO: 273 is the transmembrane domain of human INTERCEPT 217 (SEQ ID NO: 277). As described elsewhere herein, relatively hydrophilic regions are generally located at or near the surface of a protein, and are more frequently effective immunogenic epitopes than are relatively hydrophobic regions. For example, the region of human INTERCEPT 217 protein from about amino acid residue 355 to about amino acid residue 380 appears to be located at or near the surface of the protein, while the region from about amino acid residue 190 to about amino acid residue 210 appears not to be located at or near the surface. FIG. 19L depicts a hydrophobicity plot of murine INTERCEPT 217 protein.

The predicted molecular weight of human INTERCEPT 217 protein without modification and prior to cleavage of the signal sequence is about 49.8 kilodaltons. The predicted molecular weight of the mature human INTERCEPT 217 protein without modification and after cleavage of the signal sequence is about 47.4 kilodaltons.

The predicted molecular weight of murine INTERCEPT 217 protein, without modification and prior to cleavage of the signal sequence is about 35.5 kilodaltons. The predicted molecular weight of the mature human INTERCEPT 217 protein without modification and after cleavage of the signal sequence is about 33.8 kilodaltons.

Northern analysis experiments indicated that mRNA corresponding to the cDNA encoding INTERCEPT 217 is expressed in two forms, one having an apparent approximate size of about 6 kilobases and another having an apparent approximate size of about 3 kilobases (i.e., corresponding to the size of the INTERCEPT 217 cDNA). These experiments indicated that INTERCEPT 217 is expressed in the tissues listed in Table XVII, wherein "++" indicates strong expression, "+" indicates lower expression, and "+/-" indicates still lower expression.

TABLE XVII

| Animal | Tissue | Relative Level of Expression |
|---|---|---|
| Human | pancreas | ++ |
| | skeletal muscle | + |
| | heart | +/- |
| | brain | +/- |
| | placenta | +/- |
| | lung | +/- |
| | liver | +/- |
| | kidney | +/- |

An assay to detect possible secretion of INTERCEPT 217 protein was negative.

This assay was performed as described elsewhere in this disclosure.

Uses of INTERCEPT 217 Nucleic Acids, Polypeptides, and Modulators Thereof

INTERCEPT 217 proteins are involved in disorders which affect both tissues in which they are normally expressed and tissues in which they are normally not expressed. Based on the observation that INTERCEPT 217 is expressed in pancreas, skeletal muscle, heart, brain, placenta, lung, liver, and kidney tissue, INTERCEPT 217 protein is involved in one or more biological processes which occur in these tissues. In particular, INTERCEPT 217 is involved in modulating binding of cells of one or more of these tissues with proteins of other cells or with secreted proteins which occur in the extracellular environment of one or more of these tissues. INTERCEPT 217 is especially implicated in disorders of skeletal muscle (e.g., protection of skeletal muscle cells during ischemia and in bruised tissue), and more especially those involving the pancreas (e.g., diabetes, pancreatitis, and the like).

Structural similarity of human INTERCEPT 217 protein with human GP-IBa indicates that INTERCEPT 217 is involved in binding extracellular proteins and other ligands. INTERCEPT 217 protein is involved in binding of proteins which induce release of pancreatic digestive enzymes (e.g., amylases, lipases, proteases, and nucleases) from pancreatic cells, and in disorders associated with insufficient or inappropriate release of such enzymes. INTERCEPT 217 protein is also involved in binding of secreted pancreatic digestive enzymes in pancreatic tissue, thereby protecting pancreatic tissue from autodigestion. Thus, INTERCEPT 217 protein is involved in disorders such as diabetes, pancreatitis, and pancreatic carcinoma which involve acute and chronic autodigestive damage to pancreatic tissues. Homology of INTERCEPT 217 protein with porcine ribonuclease inhibitor protein is a further indication of this involvement.

The presence of LRR domains in human INTERCEPT 217 protein and detection of its expression in a variety of tissues indicate that the tissue protective functions of INTERCEPT 217 are not limited to pancreatic tissues, but are involved in protection of other tissues as well (e.g., skeletal muscle, heart, brain, placenta, lung, liver, prostate, and kidney tissues). INTERCEPT 217 is therefore involved in protection of these (and likely other tissues) from the effects of inflammation, autoimmunity, infection, and acute and chronic traumas.

Presence in INTERCEPT 217 protein of multiple SH3 domain binding sites indicates that INTERCEPT 217 protein interacts with one or more SH3 domain-containing proteins. Thus, INTERCEPT 217 protein mediates binding of proteins (i.e., binding of proteins to INTERCEPT 217 and to one another to form protein complexes) in cells in which it is expressed. INTERCEPT 217 is also involved in transduction of signals between the exterior environment of cells (i.e., including from other cells) and the interior of cells in which it is expressed. INTERCEPT 217 mediates regulation of cell growth and proliferation, endocytosis, activation of respiratory burst, and other physiological processes triggered by transmission of a signal via a protein with which INTERCEPT 217 interacts.

INTERCEPT 217-related molecules can be used to modulate one or more of the activities in which INTERCEPT 217 is involved and can also be used to prevent, diagnose, or treat one or more of the disorders in which INTERCEPT 217 is involved.

INTERCEPT 217 polypeptides, nucleic acids, and modulators thereof, can, for example, be used to treat pancreatic disorders, such as the pancreatic disorders described elsewhere in this disclosure. INTERCEPT 217 polypeptides, nucleic acids, and modulators thereof can be used to prognosticate, diagnose, inhibit, prevent, or alleviate one or more of these disorders.

In another example, INTERCEPT 217 polypeptides, nucleic acids, and modulators thereof, can be used to treat disorders of skeletal muscle, such as the skeletal muscle disorders described elsewhere in this disclosure. INTERCEPT 217 polypeptides, nucleic acids, and modulators thereof can be used to prognosticate, diagnose, inhibit, prevent, or alleviate one or more of these disorders.

Because INTERCEPT 217 exhibits expression in heart tissue, INTERCEPT 217 nucleic acids, proteins, and modulators thereof can be used to treat disorders such as the cardiovascular disorders described elsewhere in this disclosure. INTERCEPT 217 polypeptides, nucleic acids, and modulators thereof can be used to prognosticate, diagnose, inhibit, prevent, or alleviate one or more of these disorders.

In another example, INTERCEPT 217 polypeptides, nucleic acids, and modulators thereof, can be used to treat disorders of the brain, such as the brain disorders described elsewhere in this disclosure. INTERCEPT 217 polypeptides, nucleic acids, and modulators thereof can be used to prognosticate, diagnose, inhibit, prevent, or alleviate one or more of these disorders.

In another example, INTERCEPT 217 polypeptides, nucleic acids, and modulators thereof, can be used to treat placental disorders, such as toxemia of pregnancy (e.g., preeclampsia and eclampsia), placentitis, and spontaneous abortion. INTERCEPT 217 polypeptides, nucleic acids, and modulators thereof can be used to prognosticate, diagnose, inhibit, prevent, or alleviate one or more of these disorders.

In another example, INTERCEPT 217 polypeptides, nucleic acids, and modulators thereof, can be used to treat pulmonary (i.e., lung) disorders, such as atelectasis, cystic fibrosis, rheumatoid lung disease, pulmonary congestion, pulmonary edema, chronic obstructive airway disease (e.g., emphysema, chronic bronchitis, bronchial asthma, and bronchiectasis), diffuse interstitial diseases (e.g., sarcoidosis, pneumoconiosis, hypersensitivity pneumonitis, Goodpasture's syndrome, idiopathic pulmonary hemosiderosis, pulmonary alveolar proteinosis, desquamative interstitial pneumonitis, chronic interstitial pneumonia, fibrosing alveolitis, hamman-rich syndrome, pulmonary eosinophilia, diffuse interstitial fibrosis, Wegener's granulomatosis, lymphomatoid granulomatosis, and lipid pneumonia), and tumors (e.g., bronchogenic carcinoma, bronchioloalveolar carcinoma, bronchial carcinoid, hamartoma, and mesenchymal tumors). INTERCEPT 217 polypeptides, nucleic acids, and modulators thereof can be used to prognosticate, diagnose, inhibit, prevent, or alleviate one or more of these disorders.

In yet another example, INTERCEPT 217 polypeptides, nucleic acids, and modulators thereof, can be used to treat hepatic (i.e., liver) disorders, such as the liver disorders described elsewhere in this disclosure. INTERCEPT 217 polypeptides, nucleic acids, and modulators thereof can be used to prognosticate, diagnose, inhibit, prevent, or alleviate one or more of these disorders.

In still another example, INTERCEPT 217 polypeptides, nucleic acids, and modulators thereof, can be used to treat renal (i.e., kidney) disorders, such as the kidney disorders described elsewhere in this disclosure. INTERCEPT 217 polypeptides, nucleic acids, and modulators thereof can be used to prognosticate, diagnose, inhibit, prevent, or alleviate one or more of these disorders.

INTERCEPT 297

A cDNA clone (designated jthsa085g01) encoding at least a portion of human INTERCEPT 297 protein was isolated from a human fetal spleen cDNA library. The human INTERCEPT 297 protein is predicted by structural analysis to be a transmembrane protein.

The full length of the cDNA encoding human INTERCEPT 297 protein (SEQ ID NO: 279) is 1518 nucleotide residues. The ORF of this cDNA, nucleotide residues 40 to 1152 of SEQ ID NO: 279 (i.e., SEQ ID NO: 280), encodes a 371-amino acid transmembrane protein (SEQ ID NO: 281).

The invention thus includes purified human INTERCEPT 297 protein, both in the form of a 371 amino acid residue protein (SEQ ID NO: 281) in which the 'signal sequence' (i.e., the portion of INTERCEPT 297 protein corresponding to amino acid residues 1 to 18) described in this section is not cleaved and in the form of a 353 amino acid residue protein (SEQ ID NO: 283) in which the 'signal sequence' is cleaved. Human INTERCEPT 297 protein can exist with or without the signal sequence polypeptide at the amino terminus thereof. It is likely that the 'signal sequence' is not cleaved, but is instead a transmembrane domain of the protein.

The invention includes nucleic acid molecules which encode an INTERCEPT 297 polypeptide of the invention. Such nucleic acids include, for example, a DNA molecule having the nucleotide sequence listed in SEQ ID NO: 279 or some portion thereof, such as the portion which encodes mature INTERCEPT 297 protein, immature INTERCEPT 297 protein, or a domain of INTERCEPT 297 protein. These nucleic acids are collectively referred to as INTERCEPT 297 nucleic acids of the invention.

INTERCEPT 297 proteins and nucleic acid molecules encoding them comprise a family of molecules having certain conserved structural and functional features.

A common domain present in INTERCEPT 297 proteins is a signal sequence.

In one embodiment, a INTERCEPT 297 protein contains a signal sequence corresponding to about amino acid residues 1 to 18 of SEQ ID NO: 281 (SEQ ID NO: 282). The signal sequence can be cleaved during processing of the mature protein, but it is likely that amino acid residues 1 to 18 of SEQ ID NO: 281 represent a (non-cleaved) transmembrane region of the protein.

INTERCEPT 297 proteins can include one or more extracellular domains. In one embodiment of the human INTERCEPT 297 protein, extracellular domains are located from about amino acid residues 19 to 47, from about amino acid residues 110 to 118, from about amino acid residues 162 to 175, from about amino acid residues 234 to 260, and from about amino acid residues 313 to 319 of SEQ ID NO: 281 (SEQ ID NOs: 284-288, respectively). In an alternative embodiment, extracellular domains are located from about amino acid residue 69 to 88, from about amino acid residue 138 to 144, from about amino acid residue 193 to 215, from about amino acid residue 284 to 292, and from about amino acid residue 337 to 371 of SEQ ID NO: 281 (SEQ ID NOs: 298-302, respectively).

In addition, INTERCEPT 297 includes one or more transmembrane domains.

In one embodiment, a INTERCEPT 297 protein of the invention contains transmembrane domains corresponding to about amino acid residues 48 to 68, about amino acid residues 89 to 109, about amino acid residues 119 to 137, about amino acid residues 145 to 161, about amino acid residues 176 to 192, about amino acid residues 216 to 233, about amino acid residues 261 to 283, about amino acid residues 293 to 312, and about amino acid residues 320 to 336 of SEQ ID NO: 281 (SEQ ID NOs: 289-297, respectively). As indicated above, it is likely that the 'signal sequence' of INTERCEPT 297 is an additional (and non-cleaved) transmembrane region.

The present invention includes INTERCEPT 297 proteins having one or more cytoplasmic domains. In one embodiment of the human INTERCEPT 297 protein, cytoplasmic domains are located from about amino acid residue 69 to 88, from about amino acid residue 138 to 144, from about amino acid residue 193 to 215, from about amino acid residue 284 to 292, and from about amino acid residue 337 to 371 of SEQ ID NO: 281 (SEQ ID NOs: 298-302, respectively). In an alternative embodiment, cytoplasmic domains are located from about amino acid residues 19 to 47, from about amino acid residues 110 to 118, from about amino acid residues 162 to 175, from about amino acid residues 234 to 260, and from about amino acid residues 313 to 319 of SEQ ID NO: 281 (SEQ ID NOs: 284-288, respectively).

INTERCEPT 297 proteins typically comprise a variety of potential post-translational modification sites (often within an extracellular domain), such as those described herein in Table XVIII, as predicted by computerized sequence analysis of INTERCEPT 297 proteins using amino acid sequence comparison software (comparing the amino acid sequence of INTERCEPT 297 with the information in the PROSITE database {rel. 12.2; February 1995} and the Hidden Markov Models database {Rel. PFAM 3.3}). In certain embodiments, a protein of the invention has at least 1, 2, 4, 6, 10, 15, or 20 or more of the post-translational modification sites listed in Table XVIII.

TABLE XVIII

| Type of Potential Modification Site or Domain | Amino Acid Residues of SEQ ID NO: 281 | Amino Acid Sequence |
| --- | --- | --- |
| N-glycosylation site | 110 to 113 | NMTS |
| | 269 to 272 | NISS |
| Protein kinase C phosphorylation site | 24 to 26 | SAK |
| | 290 to 292 | TTR |
| | 297 to 299 | SLR |
| Casein kinase II phosphorylation site | 78 to 81 | SSVD |
| | 165 to 168 | SKHD |
| | 245 to 248 | TLED |
| | 354 to 357 | SEQE |
| N-myristoylation site | 18 to 23 | GSINTL |
| | 35 to 40 | GCGGSK |
| | 53 to 58 | GMFLGE |
| | 74 to 79 | GQSDSS |
| | 147 to 152 | GILATI |
| | 236 to 241 | GSFSGN |
| | 268 to 273 | GNISSI |
| | 280 to 285 | GISVTK |
| Amidation site | 136 to 139 | LGRR |
| DUF6 domain | 44 to 171 | |

Among the domains that occur in INTERCEPT 297 protein is a DUF6 domain. In one embodiment, the protein of the invention has at least one domain that is at least 55%, preferably at least about 65%, more preferably at least about 75%, yet more preferably at least about 85%, and most preferably at least about 95% identical to this DUF6 domain.

The DUF6 domain is a transmembrane domain that is highly conserved among eukaryote, prokaryote, and archae kingdoms. This high degree of domain sequence conservation indicates that proteins of the class which includes INTERCEPT 297 are involved in fundamental membrane physiology of living cells. INTERCEPT 297 protein is therefore involved in disorders which are associated with aberrant membrane function including, for example, disorders involving abnormal membrane fluidity, disorders involving aberrant transmembrane transport, disorders involving abnormal membrane organization, disorders involving abnormal membrane synthesis, disorders involving aberrant cell division, and the like.

The signal peptide prediction program SIGNALP (Nielsen et al. (1997) Protein Engineering 10:1-6) predicted that human INTERCEPT 297 protein includes an approximately 18 (i.e., 16, 17, 18, 19, or 20) amino acid residue signal peptide (amino acid residues 1 to 18 of SEQ ID NO: 281; SEQ ID NO: 282) preceding the mature INTERCEPT 297 protein (i.e., approximately amino acid residues 19 to 371 of SEQ ID NO: 281; SEQ ID NO: 283). In one embodiment, human INTERCEPT 297 protein includes about five extracellular domains (amino acid residues 19 to 47, 110 to 118, 162 to 175, 234 to 260, and 313 to 319 of SEQ ID NO: 281); about nine transmembrane domains (amino acid residues 48 to 68, 89 to 109, 119 to 137, 145 to 161, 176 to 192, 216 to 233, 261 to 283, 293 to 312, and 320 to 326 of SEQ ID NO: 281); and about five cytoplasmic domains (amino acid residues 69 to 88, 138 to 144, 193 to 215, 284 to 292, and 337 to 371 of SEQ ID NO: 281). In an alternative embodiment, human INTERCEPT 297 protein includes about five cytoplasmic domains (amino acid residues 19 to 47, 110 to 118, 162 to 175, 234 to 260, and 313 to 319 of SEQ ID NO: 281); about nine transmembrane domains (amino acid residues 48 to 68, 89 to 109, 119 to 137, 145 to 161, 176 to 192, 216 to 233, 261 to 283, 293 to 312, and 320 to 326 of SEQ ID NO: 281); and about five extracellular domains (amino acid residues 69 to 88, 138 to 144, 193 to 215, 284 to 292, and 337 to 371 of SEQ ID NO: 281).

FIG. 40 depicts a hydrophobicity plot of human INTERCEPT 297 protein.

Relatively hydrophobic regions are above the dashed horizontal line, and relatively hydrophilic regions are below the dashed horizontal line. Hydrophobic region corresponding to the signal sequence and the transmembrane domains are observed in this figure. As described elsewhere herein, relatively hydrophilic regions are generally located at or near the surface of a protein, and are more frequently effective immunogenic epitopes than are relatively hydrophobic regions. For example, the region of human INTERCEPT 297 protein from about amino acid residue 165 to about amino acid residue 175 appears to be located at or near the surface of the protein.

The predicted molecular weight of human INTERCEPT 297 protein without modification and prior to cleavage of the signal sequence is about 40.2 kilodaltons. The predicted molecular weight of the mature human INTERCEPT 297 protein without modification and after cleavage of the signal sequence is about 38.2 kilodaltons.

Uses of INTERCEPT 297 Nucleic Acids, Polypeptides, and Modulators Thereof

INTERCEPT 297 proteins are involved in disorders which affect both tissues in which they are normally expressed and tissues in which they are normally not expressed. Based on the observation that INTERCEPT 297 is expressed in human fetal spleen, INTERCEPT 297 protein is involved in one or more biological processes which occur in fetal and spleen tissues. In particular, INTERCEPT 297 is involved in modulating growth, proliferation, survival, differentiation, and activity of cells including, but not limited to, spleen and fetal cells of the animal in which it is normally expressed. Thus, INTERCEPT 297 has a role in disorders which affect these cells and their growth, proliferation, survival, differentiation, and activity (e.g., hematologic and immune disorders).

Expression of INTERCEPT 297 in an animal is also involved in modulating growth, proliferation, survival, differentiation, and activity of cells and viruses which are foreign to the host (i.e., bacterial, fungal, and viral infections).

INTERCEPT 297 bears amino acid sequence similarity to *Caenorhabditis elegans* protein C2G12.12, and therefore exhibits one or more activities analogous to that protein.

INTERCEPT 297 nucleic acids, proteins, and modulators thereof can be used to modulate proliferation, migration, morphology, differentiation, function, or some combination of these, of cells that form the spleen, (e.g., cells of the splenic connective tissue, splenic smooth muscle cells, or endothelial cells of the splenic blood vessels) or of blood cells that are processed. (e.g., regenerated, matured, or phagocytized) within the spleen, as described elsewhere in this disclosure. INTERCEPT 297 polypeptides, nucleic acids, and modulators thereof can be used to prognosticate, diagnose, inhibit, prevent, or alleviate one or more of these disorders.

Structural analysis of INTERCEPT 297 and the presence of a DUF6 domain therein indicate that INTERCEPT 297 is involved in disorders which affect membrane structure and function. INTERCEPT 297 can be used to affect development and persistence of disorders involving inappropriate membrane structure and function, such as atherogenesis, arteriosclerosis, and various transmembrane transport disorders.

Other examples of disorders for which INTERCEPT 297 is useful include disorders involving generation and persistence of an immune response to bacterial, fungal, and viral infections. INTERCEPT 297 polypeptides, nucleic acids, and modulators thereof can be used to prognosticate, diagnose, inhibit, prevent, or alleviate one or more of these disorders.

The structure of INTERCEPT 297 is analogous to the structures of integral membrane proteins responsible for transmembrane transport of molecules such as sugars, ions, and the like. INTERCEPT 297 is thus involved in one or more transmembrane transport-related disorders such as cystic fibrosis, nerve conduction disorders (e.g., pain and loss or failure of sensation), muscle contraction disorders (e.g., cardiac insufficiency), metal ion uptake disorders (e.g., hemochromatosis), and the like. INTERCEPT 297 polypeptides, nucleic acids, and modulators thereof can be used to prognosticate, diagnose, inhibit, prevent, or alleviate one or more of these disorders.

TANGO 276

A cDNA clone (designated jthsa006e01) encoding at least a portion of human TANGO 276 protein was isolated from a human fetal spleen cDNA library. The human TANGO 276 protein is predicted by structural analysis to be a secreted protein.

The full length of the cDNA encoding human TANGO 276 protein (SEQ ID NO: 303) is 2811 nucleotide residues. The ORF of this cDNA, nucleotide residues 58 to 786 of SEQ ID NO: 303 (i.e., SEQ ID NO: 304), encodes a 243-amino acid secreted protein (SEQ ID NO: 305).

The invention thus includes purified human TANGO 276 protein, both in the form of the immature 243 amino acid residue protein (SEQ ID NO: 305) and in the form of the mature, approximately 223 amino acid residue protein (SEQ ID NO: 307). Mature human TANGO 276 protein can be synthesized without the signal sequence polypeptide at the amino terminus thereof, or it can be synthesized by generating immature TANGO 276 protein and cleaving the signal sequence therefrom.

The invention includes nucleic acid molecules which encode a TANGO 276 polypeptide of the invention. Such nucleic acids include, for example, a DNA molecule having the nucleotide sequence listed in SEQ ID NO: 303 or some portion thereof, such as the portion which encodes mature TANGO 276 protein, immature TANGO 276 protein, or a domain of TANGO 276 protein. These nucleic acids are collectively referred to as TANGO 276 nucleic acids of the invention.

TANGO 276 proteins and nucleic acid molecules encoding them comprise a family of molecules having certain conserved structural and functional features, as indicated by the conservation of amino acid sequence between human TANGO 276 protein and the murine protein designated M-Sema-F (see Inagaki et al. (1995) FEBS Lett. 370:269-272), as shown in FIGS. 42A-42C.

A common domain present in TANGO 276 proteins is a signal sequence. In one embodiment, a TANGO 276 protein contains a signal sequence corresponding to about amino acid residues 1 to 20 of SEQ ID NO: 305 (SEQ ID NO: 306). The signal sequence is cleaved during processing of the mature protein.

TANGO 276 proteins can exist in a secreted form, such as a mature protein having the amino acid sequence of amino acid residues 21 to 243 of SEQ ID NO: 305 (SEQ ID NO: 307).

TANGO 276 proteins typically comprise a variety of potential post-translational modification sites (often within an extracellular domain), such as those described herein in Table XIX, as predicted by computerized sequence analysis of TANGO 276 proteins using amino acid sequence comparison software (comparing the amino acid sequence of TANGO 276 with the information in the PROSITE database {rel. 12.2; February 1995} and the Hidden Markov Models database {Rel. PFAM 3.3}). In certain embodiments, a protein of the invention has at least 1, 2, 4, 6, or all 8 of the post-translational modification sites listed in Table XIX.

TABLE XIX

| Type of Potential Modification Site or Domain | Amino Acid Residues of SEQ ID NO: 305 | Amino Acid Sequence |
| --- | --- | --- |
| N-glycosylation site | 106 to 109 | NQTE |
|  | 121 to 124 | NASH |
| cAMP- or cGMP-dependent protein kinase phosphorylation site | 43 to 46 | RRFS |
| Protein kinase C phosphorylation site | 194 to 196 | SLK |
| Casein kinase II phosphorylation site | 34 to 37 | SSGE |
|  | 57 to 60 | TLTE |
| N-myristoylation site | 16 to 21 | GLGIGA |
|  | 68 to 73 | GAREAL |
| Sema domain | 53 to 141 |  |

A Sema domain occurs in human TANGO 276 protein. In one embodiment, the protein of the invention has at least one domain that is at least 55%, preferably at least about 65%, more preferably at least about 75%, yet more preferably at least about 85%, and most preferably at least about 95% identical to this Sema domain.

Sema domains occur in semaphorin proteins. Semaphorins are a large family of secreted and transmembrane proteins, some of which function as repellent signals during neural axon guidance. The Sema domain and a variety of semaphorin proteins in which it occurs are described, for example, in Winberg et al. (1998 Cell 95:903-916). Sema domains also occur in human hepatocyte growth factor receptor (SwissProt Accession no. P08581) and the similar neuronal and epithelial transmembrane receptor protein (SwissProt Accession no. P51805). The presence of a Sema domain in human TANGO 276 protein indicates that TANGO 276 is involved in one or more physiological processes in which the semaphorins are involved, has biological activity in common with one or more of the semaphorins, or both.

Human TANGO 276 protein exhibits considerable sequence similarity to murine M-Sema F protein (GenBank Accession no. S79463), as indicated herein in FIGS. 42A-43C. FIGS. 42A-42C depict an alignment of the amino acid sequences of human TANGO 276 protein (SEQ ID NO: 305) and murine M-Sema F protein (SEQ ID NO: 335). In this alignment (pam120.mat scoring matrix, gap opening penalty=12, gap extension penalty=4), the amino acid sequences of the proteins are 76.1% identical. FIGS. 43A-43J depict an alignment of the nucleotide sequences of cDNA encoding human TANGO 276 protein (SEQ ID NOs: 303) and murine cDNA encoding M-Sema F protein (SEQ ID NO: 336). In this alignment (pam120.mat scoring matrix, gap opening penalty=12, gap extension penalty=4), the nucleic acid sequences of the cDNAs are 79.7% identical. Thus, TANGO 276 is related to murine M-Sema F and shares functional similarities to that protein.

It is known that semaphorins are bi-functional, capable of functioning either as attractive axonal guidance proteins or as repellent axonal guidance proteins (Wong et al. (1997) Development 124:3597-3607). Furthermore, semaphorins bind with neuronal cell surface proteins designated plexins, which are expressed on both neuronal cells and cells of the immune system (Comeau et al. (1998) Immunity 8:473-482; Jin and Strittmatter (1997) J. Neurosci. 17:6256-6263).

The signal peptide prediction program SIGNALP (Nielsen et al. (1997) Protein Engineering 10:1-6) predicted that human TANGO 276 protein includes an approximately 20 (i.e., 18, 19, 20, 21, or 22) amino acid signal peptide (amino acid residues 1 to 20 of SEQ ID NO: 305; SEQ ID NO: 306) preceding the mature TANGO 276 protein (i.e., approximately amino acid residues 21 to 243 of SEQ ID NO: 304; SEQ ID NO: 307). Human TANGO 276 protein is a secreted protein.

FIG. 41 depicts a hydrophobicity plot of human TANGO 276 protein.

Relatively hydrophobic regions are above the dashed horizontal line, and relatively hydrophilic regions are below the dashed horizontal line. The hydrophobic region which corresponds to about amino acid residues 1 to 20 of SEQ ID NO: 305 is the signal sequence of human TANGO 276. As described elsewhere herein, relatively hydrophilic regions are generally located at or near the surface of a protein, and are more frequently effective immunogenic epitopes than are relatively hydrophobic regions. For example, the region of human TANGO 276 protein from about amino acid residue 90 to about amino acid residue 105 appears to be located at or near the surface of the protein, while the region from about amino acid residue 170 to about amino acid residue 180 appears not to be located at or near the surface.

The predicted molecular weight of human TANGO 276 protein without modification and prior to cleavage of the signal sequence is about 27.1 kilodaltons. The predicted molecular weight of the mature human TANGO 276 protein without modification and after cleavage of the signal sequence is about 24.8 kilodaltons.

Northern analysis experiments indicated that mRNA corresponding to the cDNA encoding TANGO 276 is expressed in the tissues listed in Table XX, wherein "++" indicates a greater level of expression and "+" indicates a lower level of expression.

TABLE XX

| Animal | Tissue | Relative Level of Expression |
|---|---|---|
| Human | heart | ++ |
|  | placenta | ++ |
|  | brain | + |
|  | lung | + |
|  | liver | + |
|  | skin | + |
|  | kidney | + |
|  | pancreas | + |

Uses of TANGO 276 Nucleic Acids, Polypeptides, and Modulators Thereof

TANGO 276 proteins are involved in disorders which affect both tissues in which they are normally expressed and tissues in which they are normally not expressed. Based on the observation that TANGO 276 is expressed in human heart and placenta tissues, to a lesser extent in brain, lung, liver, skin, kidney, and pancreas tissues, and in fetal spleen tissue, TANGO 276 protein is involved in one or more biological processes which occur in these tissues. In particular, TANGO 276 is involved in modulating growth, proliferation, survival, differentiation, and activity of cells including, but not limited to, heart, placenta, spleen, brain, lung, liver, skin, kidney, and pancreas cells of the animal in which it is normally expressed. Thus, TANGO 276 has a role in disorders which affect these cells and their growth, proliferation, survival, differentiation, and activity.

Because TANGO 276 exhibits expression in the heart, TANGO 276 nucleic acids, proteins, and modulators thereof can be used to treat cardiovascular disorders, such as those described elsewhere in this disclosure. TANGO 276 polypeptides, nucleic acids, or modulators thereof can be used to prognosticate, diagnose, inhibit, prevent, or alleviate one or more of these disorders.

In another example, TANGO 276 polypeptides, nucleic acids, and modulators thereof can be used to treat placental disorders, such as those described elsewhere in this disclosure. TANGO 276 polypeptides, nucleic acids, and modulators thereof can be used to prognosticate, diagnose, inhibit, prevent, or alleviate one or more of these disorders.

In another example, TANGO 276 polypeptides, nucleic acids, or modulators thereof, can be used to treat disorders of the brain, such as the brain disorders described elsewhere in this disclosure. TANGO 276 polypeptides, nucleic acids, and modulators thereof can be used to prognosticate, diagnose, inhibit, prevent, or alleviate one or more of these disorders.

TANGO 276 polypeptides, nucleic acids, and modulators thereof can be associated with pulmonary (i.e., lung) disorders, such as the pulmonary disorders described elsewhere in this disclosure. TANGO 276 polypeptides, nucleic acids, or modulators thereof can be used to prognosticate, diagnose, inhibit, prevent, or alleviate one or more of these disorders.

In another example, TANGO 276 polypeptides, nucleic acids, and modulators thereof, can be used to treat hepatic (i.e., liver) disorders, such as the liver disorders described elsewhere in this disclosure. TANGO 276 polypeptides, nucleic acids, and modulators thereof can be used to prognosticate, diagnose, inhibit, prevent, or alleviate one or more of these disorders.

Examples of skin disorders with which TANGO 276 can be associated include those described elsewhere in this disclosure. TANGO 276 proteins, nucleic acids encoding them, and agents that modulate activity or expression of either of these can be used to prognosticate, diagnose, treat, and inhibit one or more of these disorders.

In another example, TANGO 276 polypeptides, nucleic acids, or modulators thereof, can be used to treat renal (i.e., kidney) disorders, such as the kidney disorders described elsewhere in this disclosure. TANGO 276 polypeptides, nucleic acids, and modulators thereof can be used to prognosticate, diagnose, inhibit, prevent, or alleviate one or more of these disorders.

Pancreatic disorders in which TANGO 276 can be involved include the pancreatic disorders described elsewhere in this disclosure. TANGO 276 polypeptides, nucleic acids, or modulators thereof can be used to prognosticate, diagnose, inhibit, prevent, or alleviate one or more of these disorders.

The presence of the Sema domain in TANGO 276 indicates that this protein is involved in development of neuronal and epithelial tissues and also functions as a repellant protein which guides axonal development. TANGO 276 modulates nerve growth and regeneration and also modulates growth and regeneration of other epithelial tissues. TANGO 276 is thus involved in a variety of neuronal disorder including, but not limited to, one or more of seizure, epilepsy, (regeneration of) neuronal damage, pain (including, for example, migraine, headache, and other chronic pain), infections of the central nervous system, multiple sclerosis, sleep disorders, psychological disorders, nerve root disorders, and the like. Presence of a Sema domain in TANGO 276 further indicates that TANGO 276 has one or more physiological roles in common with other proteins (e.g., secreted and transmembrane semaphorins, collapsins, neuropilins, plexins, and the like) in which the Sema domain occurs. Thus, TANGO 276 is implicated in development, maintenance, and regeneration of neuronal connections and networks, in modulating differentiation of cells of the immune system, in modulating cytokine production by cells of the immune system, in modulating reactivity of cells of the immune system toward cytokines, in modulating initiation and persistence of an inflammatory response, and in modulating proliferation of epithelial cells. Sema domain-containing proteins have also been implicated in development and progression of small cell lung cancer, in normal brain development, and immune system regulation. This indicates that TANGO 276 is also involved in one or more of these processes and in disorders relating to these processes (e.g., small cell lung cancer, brain development disorders, and immune and auto-immune disorders). TANGO 276 polypeptides, nucleic acids, and modulators thereof can be used to prognosticate, diagnose, inhibit, prevent, or alleviate one or more of these disorders.

The observation that TANGO 276 shares identity with the murine semaphorin protein designated M-Sema F suggests that TANGO 276 has activity identical or analogous to the activity of this protein. These observations indicate that TANGO 276 modulates growth, proliferation, survival, differentiation, and activity of neuronal cells. Thus, TANGO 276 protein is useful, for example, for modulating and guiding neural axon development and for modulating establishment and maintenance of neuronal networks.

TANGO 292

A cDNA clone (designated jthkf040b11) encoding at least a portion of human TANGO 292 protein was isolated from a human normal embryonic keratinocyte cDNA library. A corresponding gerbil cDNA clone (designated jtiba040e12) was also isolated, and encoded at least a portion of gerbil TANGO 292 protein. The human and TANGO 292 proteins are predicted by structural analysis to be transmembrane proteins.

The full length of the cDNA encoding human TANGO 292 protein (SEQ ID NO: 308) is 2498 nucleotide residues. The ORF of this cDNA, nucleotide residues 205 to 882 of SEQ ID NO: 308 (i.e., SEQ ID NO: 309), encodes a 226-amino acid residue transmembrane protein (SEQ ID NO: 310). The full length of the cDNA encoding gerbil TANGO 292 protein (SEQ ID NO: 351) is 2002 nucleotide residues. The ORF of this cDNA, nucleotide residues 89 to 763 of SEQ ID NO: 351 (i.e., SEQ ID NO: 352), encodes a 225-amino acid transmembrane protein (SEQ ID NO: 353).

The invention thus includes purified human TANGO 292 protein, both in the form of the immature 226 amino acid residue protein (SEQ ID NO: 310) and in the form of the mature, approximately 209 amino acid residue protein (SEQ ID NO: 312).

The invention also includes purified gerbil TANGO 292 protein, both in the form of the immature 225-amino acid residue (SEQ ID NO: 353) protein and in the form of the mature, approximately 208-amino acid residue protein (SEQ ID NO: 355). Mature human or gerbil TANGO 292 protein can be synthesized without the signal sequence polypeptide at the amino terminus thereof, or it can be synthesized by generating immature TANGO 292 protein and cleaving the signal sequence therefrom.

The invention includes nucleic acid molecules which encode a TANGO 292 polypeptide of the invention. Such nucleic acids include, for example, a DNA molecule having the nucleotide sequence listed in SEQ ID NO: 308 or 351 or some portion thereof, such as the portion which encodes mature human or gerbil TANGO 292 protein, immature human or gerbil TANGO 292 protein, or a domain of human or gerbil TANGO 292 protein. These nucleic acids are collectively referred to as TANGO 292 nucleic acids of the invention.

TANGO 292 proteins and nucleic acid molecules encoding them comprise a family of molecules having certain conserved structural and functional features. This family includes, for example, human and gerbil TANGO 292 proteins and nucleic acid molecules described herein.

A common domain present in TANGO 292 proteins is a signal sequence. In one embodiment, a TANGO 292 protein contains a signal sequence corresponding to about amino acid residues 1 to 17 of SEQ ID NO: 310 (SEQ ID NO: 311) or to about amino acid residues 1 to 17 of SEQ ID NO: 353 (SEQ ID NO: 354). The signal sequence is cleaved during processing of the mature protein.

TANGO 292 proteins can include an extracellular domain. The human TANGO 292 protein extracellular domain is located from about amino acid residue 18 to about amino acid residue 113 of SEQ ID NO: 310 (SEQ ID NO: 313). The gerbil TANGO 292 protein extracellular domain includes at least about amino acid residues 18 to 112 of SEQ ID NO: 353 (SEQ ID NO: 356).

In addition, TANGO 292 include a transmembrane domain. In one embodiment, a human TANGO 292 protein contains a transmembrane domain corresponding to about amino acid residues 114 to 138 of SEQ ID NO: 310 (SEQ ID NO: 314). Gerbil TANGO 292 protein includes a transmembrane domain corresponding to about amino acid residues 113 to 137 of SEQ ID NO: 353 (SEQ ID NO: 357).

The present invention includes TANGO 292 proteins having a cytoplasmic domain, particularly including proteins having a carboxyl-terminal cytoplasmic domain. The human TANGO 292 cytoplasmic domain is located from about amino acid residue 139 to amino acid residue 226 of SEQ ID NO: 310 (SEQ ID NO: 315).

The gerbil TANGO 292 cytoplasmic domain is located from about amino acid residue 138 to amino acid residue 225 of SEQ ID NO: 353 (SEQ ID NO: 358).

TANGO 292 proteins typically comprise a variety of potential post-translational modification sites (often within an extracellular domain), such as those described herein in Table XXIa as predicted by computerized sequence analysis of human TANGO 292 protein, or in Table XXIb as predicted by computerized sequence analysis of gerbil TANGO 292 protein, using amino acid sequence comparison software (comparing the amino acid sequence of TANGO 292 with the information in the PROSITE database {rel. 12.2; February 1995} and the Hidden Markov Models database {Rel. PFAM 3.3}). In certain embodiments, a protein of the invention has at least 1, 2, 4, 6, or all of the post-translational modification sites listed in Table XXIa or in Table XXIb.

TABLE XXIa

| Type of Potential Modification Site or Domain | Amino Acid Residues of SEQ ID NO: 310 | Amino Acid Sequence |
|---|---|---|
| cAMP-or cGMP-dependent protein kinase phosphorylation site | 197 to 200 | RKHS |
| Protein kinase C phosphorylation site | 37 to 39 | TSK |
|  | 97 to 99 | SAK |
|  | 102 to 104 | TTK |
|  | 196 to 198 | TRK |
| Casein kinase II phosphorylation site | 37 to 40 | TSKE |
|  | 103 to 106 | TKSD |
|  | 180 to 183 | SVED |
| N-myristoylation site | 116 to 121 | GLLTGL |
| Vitamin K-dependent carboxylation domain | 56 to 98 |  |

TABLE XXIb

| Type of Potential Modification Site or Domain | Amino Acid Residues of SEQ ID NO: 353 | Amino Acid Sequence |
|---|---|---|
| cAMP-or cGMP-dependent protein kinase phosphorylation site | 196 to 199 | RKHS |
| Protein kinase C phosphorylation site | 23 to 25 | SLK |
|  | 37 to 39 | SKK |
|  | 96 to 98 | SVK |
|  | 101 to 103 | TTR |
|  | 155 to 157 | TRR |
|  | 195 to 197 | TRK |
| Casein kinase II phosphorylation site | 74 to 77 | SYEE |
|  | 102 to 105 | TRSD |
|  | 155 to 157 | THEE |
|  | 195 to 197 | SSSE |
| N-myristoylation site | 33 to 38 | GVFASK |
|  | 115 to 120 | GLLTGL |
| Vitamin K-dependent carboxylation domain | 55 to 92 |  |

Among the domains that occur in TANGO 292 protein is a vitamin K-dependent carboxylation domain. In one embodiment, the protein of the invention has at least one domain that is at least 55%, preferably at least about 65%, more preferably at least about 75%, yet more preferably at least about 85%, and most preferably at least about 95% identical to this vitamin K-dependent carboxylation domain.

The vitamin K-dependent carboxylation domain has the following consensus sequence (SEQ ID NO: 454), wherein standard single-letter amino acid codes are used and 'X' refers to any amino acid residue. —$X_{12}$-E-$X_3$-E-X—C— $X_6$-(D or E or N)—X-(L or I or V or M or F or Y)-Xg-(F or Y or W)-Glutamic acid residues within this consensus region are potential vitamin K-dependent carboxylation sites. Human TANGO 292 has 9 glutamic acid residues in the vitamin K-dependent carboxylation domain located from about amino acid residue 56 to 98 of SEQ ID NO: 310, namely at amino acid residues 58, 66, 68, 71, 72, 77, 78, 81, and 86 of SEQ ID NO: 310, and gerbil TANGO 292 has 10 glutamic acid residues in the vitamin K-dependent carboxylation domain located from about amino acid residue 55 to 92 of SEQ ID NO: 353, namely at amino acid residues 57, 65, 67, 70, 71, 76, 77, 80, 86, and 87 of SEQ ID NO: 353. In one embodiment, the protein of the invention is carboxylated at one or more of these glutamic acid residues. In some proteins in which a vitamin K-dependent carboxylation domain occurs, many of the glutamic acid residues which occur from the amino terminus of the protein through the conserved aromatic residue at the carboxyl terminal end of the domain are carboxylated. Human TANGO 292 has 13 glutamic acid residues in the region from the amino terminus of (both the immature and mature forms of) the protein and the tryptophan residue at amino acid residue 93 of SEQ ID NO: 310, and also has another glutamic acid residue at position 95 of SEQ ID NO: 310 which can also be carboxylated. In addition, human TANGO 292 protein has four sets of paired (i.e., adjacent) glutamic acid residues, at residues 33-34, 40-41, 71-72, and 77-78 and a pair of glutamic acid residues (66 and 68) which are separated by a single residue. Similarly, gerbil TANGO 292 has 12 glutamic acid residues in the region from the amino terminus of (both the immature and mature forms of) the protein and the tryptophan residue at amino acid residue 92 of SEQ ID NO: 353, and also has another glutamic acid residue at position 94 of SEQ ID NO: 353 which can also be carboxylated. In addition, gerbil TANGO 292 protein has three sets of glutamic acid residues, at residues 70-71, 76-77, and 86-87, and a pair of glutamic acid residues (65 and 67) which are separated by a single residue. The protein of the invention includes proteins which are carboxylated at one or more of the individual or paired glutamic acid residues.

TANGO 292, like other vitamin K-dependent carboxylation domain-containing proteins, is involved in binding, uptake, and response to metal cations such as calcium, to proteins, and to small molecules. Other proteins in which a vitamin K-dependent carboxylation domain occurs include, for example, osteocalcin (bone-Gla protein), matrix Gla protein, various plasma proteins such as prothrombin, coagulation factors VII, IX, and X, proline rich Gla domain-containing proteins PRGP1 and PRGP2, and proteins C, S, and Z. Thus, TANGO 292 is involved in physiological processes in which one or more of these other vitamin K-dependent carboxylation domain-containing proteins is involved.

The signal peptide prediction program SIGNALP (Nielsen et al. (1997) Protein Engineering 10:1-6) predicted that human TANGO 292 protein includes an approximately 17 (i.e., 15, 16, 17, 18, or 19) amino acid residue signal peptide (amino acid residues 1 to 17 of SEQ ID NO: 310; SEQ ID NO: 311) preceding the mature TANGO 292 protein (i.e., approximately amino acid residues 18 to 226 of SEQ ID NO: 310; SEQ ID NO: 312). In one embodiment, human TANGO 292 protein includes an extracellular domain (amino acid residues 18 to 113 of SEQ ID NO: 310; SEQ ID NO: 313); a transmembrane domain (amino acid residues 114 to 138 of SEQ ID NO: 310; SEQ ID NO: 314); and a cytoplasmic domain (amino acid residues 139 to 225 of SEQ ID NO: 310; SEQ ID NO: 315). In an alternative embodiment, human TANGO 292 protein includes a cytoplasmic domain (amino acid residues 18 to 113 of SEQ ID NO: 310; SEQ ID NO: 313); a transmembrane domain (amino acid residues 114 to 138 of SEQ ID NO: 310; SEQ ID NO: 314); and an extracellular domain (amino acid residues 139 to 225 of SEQ ID NO: 310; SEQ ID NO: 315).

The SignalP program predicted that gerbil TANGO 292 protein includes an approximately 17 (i.e., 15, 16, 17, 18, or 19) amino acid residue amino acid signal peptide (amino acid residues 1 to 17 of SEQ ID NO: 353; SEQ ID NO: 354) preceding the mature TANGO 292 protein (i.e., approximately amino acid residues 18 to 225 of SEQ ID NO: 353; SEQ ID NO: 355). In one embodiment, gerbil TANGO 292 protein includes an extracellular domain (amino acid residues 18 to 112 of SEQ ID NO: 353; SEQ ID NO: 356); a transmembrane domain (amino acid residues 113 to 137 of SEQ ID NO: 353; SEQ ID NO: 357); and a cytoplasmic domain (amino acid residues 138 to 225 of SEQ ID NO: 353; SEQ ID NO: 358). In an alternative embodiment, gerbil TANGO 292 protein includes a cytoplasmic domain (amino acid residues 18 to 112 of SEQ ID NO: 353; SEQ ID NO: 356); a transmembrane domain (amino acid residues 113 to 137 of SEQ ID NO: 353; SEQ ID NO: 357); and an extracellular domain (amino acid residues 138 to 225 of SEQ ID NO: 353; SEQ ID NO: 358).

FIG. 44 depicts a hydrophobicity plot of human TANGO 292 protein.

Relatively hydrophobic regions are above the dashed horizontal line, and relatively hydrophilic regions are below the dashed horizontal line. The hydrophobic region which corresponds to amino acid residues 1 to 17 of SEQ ID NO: 310 is the signal sequence of human TANGO 292. The hydrophobic region which corresponds to amino acid residues 114 to 138 of SEQ ID NO: 310 is the transmembrane domain of human TANGO 292. As described elsewhere herein, relatively hydrophilic regions are generally located at or near the surface of a protein, and are more frequently effective immunogenic epitopes than are relatively hydrophobic regions. For example, the region of human TANGO 292 protein from about amino acid residue 90 to about amino acid residue 110 appears to be located at or near the surface of the protein, while the region from about amino acid residue 190 to about amino acid residue 195 appears not to be located at or near the surface.

FIG. 47 depicts a hydrophobicity plot of gerbil TANGO 292 protein. Relatively hydrophobic regions are above the dashed horizontal line, and relatively hydrophilic regions are below the dashed horizontal line. The hydrophobic region which corresponds to amino acid residues 1 to 17 of SEQ ID NO: 353 is the signal sequence of gerbil TANGO 292. The hydrophobic region which corresponds to amino acid residues 113 to 137 of SEQ ID NO: 353 is the transmembrane domain of gerbil TANGO 292. As described elsewhere herein, relatively hydrophilic regions are generally located at or near the surface of a protein, and are more frequently effective immunogenic epitopes than are relatively hydrophobic regions. For example, the region of gerbil TANGO 292 protein from about amino acid residue 90 to about amino acid residue 110 appears to be located at or near the surface of the protein.

An alignment of the human (H) and gerbil (G) ORF sequences encoding TANGO 292 protein is shown in FIGS. 45A-45C. This alignment was made using the ALIGN software {Myers and Miller (1989) CABIOS, ver. 2.0}; pam120.mat scoring matrix; gap opening penalty=12, gap extension penalty=4), and indicates about 64.1% identity between these two cDNA sequences. An alignment of the amino acid sequences of gerbil (G) and human (H) TANGO 292 proteins is shown in FIG. 22L. In this alignment (made using the ALIGN software {Myers and Miller (1989) CABIOS, ver. 2.0}; pam120.mat scoring matrix; gap opening penalty=12, gap extension penalty=4), the proteins are about 77.7% identical and about 80% similar.

The predicted molecular weight of human TANGO 292 protein without modification and prior to cleavage of the signal sequence is about 25.4 kilodaltons. The predicted molecular weight of the mature human TANGO 292 protein without modification and after cleavage of the signal sequence is about 23.6 kilodaltons. The predicted molecular weight of gerbil TANGO 292 protein without modification and prior to cleavage of the signal sequence is about 25.4 kilodaltons. The predicted molecular weight of the mature human TANGO 292 protein without modification and after cleavage of the signal sequence is about 23.5 kilodaltons.

Northern analysis experiments indicated that human mRNA corresponding to the cDNA encoding TANGO 292 is expressed in the tissues listed in Table XXIc, wherein "++" indicates strong expression, "+" indicates lower expression, "+/−" indicates still lower expression, and indicates that expression could not be detected in the corresponding tissue.

TABLE XXIc

| Animal | Tissue | Relative Level of Expression |
|---|---|---|
| Human | placenta | ++ |
| | liver | ++ |
| | kidney | ++ |
| | lung | + |
| | pancreas | + |
| | heart | +/− |
| | brain | − |
| | skeletal muscle | − |

Uses of INTERCEPT 292 Nucleic Acids, Polypeptides, and Modulators Thereof

TANGO 292 proteins are involved in disorders which affect both tissues in which they are normally expressed and tissues in which they are normally not expressed. Based on the observation that TANGO 292 is expressed in human embryonic keratinocytes, and in placenta, liver, kidney, lung, pancreas, and heart tissues, TANGO 292 protein is involved in one or more biological processes which occur in these tissues. In particular, TANGO 292 is involved in modulating growth, proliferation, survival, differentiation, and activity of cells including, but not limited to, keratinocytes and cells with which keratinocytes interact in the animal in which TANGO 292 is normally expressed. TANGO 292 is also involved in modulating growth, proliferation, survival, differentiation, and activity of placenta, liver, kidney, lung, pancreas, and heart cells. Thus, TANGO 292 has a role in disorders which affect these cells and their growth, proliferation, survival, differentiation, and activity. TANGO 292 polypeptides, nucleic acids, and modulators thereof can be used to prognosticate, diagnose, inhibit, prevent, or alleviate one or more of these disorders.

In another example, TANGO 292 polypeptides, nucleic acids, and modulators thereof can be used to treat placental disorders, such as those described elsewhere in this disclosure. TANGO 292 polypeptides, nucleic acids, and modulators thereof can be used to prognosticate, diagnose, inhibit, prevent, or alleviate one or more of these disorders.

In another example, TANGO 292 polypeptides, nucleic acids, and modulators thereof, can be used to treat hepatic (i.e., liver) disorders, such as the liver disorders described elsewhere in this disclosure. TANGO 292 polypeptides, nucleic acids, and modulators thereof can be used to prognosticate, diagnose, inhibit, prevent, or alleviate one or more of these disorders.

In another example, TANGO 292 polypeptides, nucleic acids, or modulators thereof, can be used to treat renal (i.e., kidney) disorders, such as the kidney disorders described elsewhere in this disclosure. TANGO 292 polypeptides, nucleic acids, and modulators thereof can be used to prognosticate, diagnose, inhibit, prevent, or alleviate one or more of these disorders.

TANGO 292 polypeptides, nucleic acids, and modulators thereof can be associated with pulmonary (i.e., lung) disorders, such as the lung disorders described elsewhere in this disclosure. TANGO 292 polypeptides, nucleic acids, or modulators thereof can be used to prognosticate, diagnose, inhibit, prevent, or alleviate one or more of these disorders.

Pancreatic disorders in which TANGO 292 can be involved include the pancreatic disorders described elsewhere in this disclosure. TANGO 292 polypeptides, nucleic acids, or modulators thereof can be used to prognosticate, diagnose, inhibit, prevent, or alleviate one or more of these disorders.

Because TANGO 292 exhibits expression in the heart, TANGO 292 nucleic acids, proteins, and modulators thereof can be used to treat cardiovascular disorders.

Examples of cardiovascular disorders with which TANGO 292 can be involved include those described elsewhere in this disclosure. TANGO 292 polypeptides, nucleic acids, or modulators thereof can be used to prognosticate, diagnose, inhibit, prevent, or alleviate one or more of these disorders.

Presence in TANGO 292 of a vitamin K-dependent carboxylation (Gla) domain indicates that TANGO 292 is involved in physiological functions identical or analogous to the functions performed by other proteins having such domains. For example, like other Gla domain-containing proteins, TANGO 292 modulates binding and uptake of calcium and other metal ions by cells which express it and the response of those cells to the presence and uptake of such ions. Human matrix Gla protein, for example, is involved in Keutel syndrome, an autosomal recessive disorder characterized by abnormal cartilage calcification, peripheral pulmonary stenosis, and midfacial hypoplasia (Munroe et al. (1999) Nat. Genet. 21:142-144). Other proteins containing a Gla domain include, for example, two human proline-rich Gla proteins designated PRGPI and PRGP2, human G domain-containing protein Gas6, and several human blood coagulation factors (Kulman et al. (1997) Proc. Natl. Acad. Sci. USA 94:9058-9062; Mark et al., (1996) J. Biol. Chem. 271:9785-9786; Cancela et al. (1990) J. Biol. Chem. 265:15040-15048). These proteins are involved in binding of mineral ions such as calcium, phosphate, and hydroxyapatite, binding of proteins, binding of vitamins and small molecules, and mediation of blood coagulation. Thus, TANGO 292 is involved in numerous physiological processes which are influenced by levels of calcium and other metal ions in body fluids or by the presence of proteins, vitamins, or small molecules. Such processes include, for example, bone uptake, maintenance, and deposition, formation, maintenance, and repair of cartilage, formation and maintenance of extracellular matrices, movement of cells through extracellular matrices, coagulation and dissolution of blood components (e.g., blood cells and proteins), and deposition of materials (e.g., lipids, cells, calcium, and the like) in arterial walls. TANGO 292 polypeptides, nucleic acids, and modulators thereof can be used to prognosticate, diagnose, inhibit, prevent, or alleviate one or more of these disorders.

TANGO 292 is involved in disorders which affect the tissues in which it is normally expressed and upon which it normally acts. Thus, TANGO 292 is involved in disorders which involve aberrant binding or aberrant failure to bind of keratinocytes or similar cells with a tissue affected by the disorder. Such disorders include, by way of example and not limitation, osteoporosis, (repair of) traumatic bone injuries, rickets, osteomalacia, Paget's disease, and other bone disorders, osteoarthritis, rheumatoid arthritis, ankylosing spondylitis, Keutel syndrome, and other disorders of the joints and cartilage, iron deficiency anemia, hemophilia, inappropriate blood coagulation, stroke, arteriosclerosis, atherosclerosis, aneurysm, and other disorders related to blood and blood vessels, metastasis and other disorders related to inappropriate movement of cells through extracellular matrices, and the like. TANGO 292 polypeptides, nucleic acids, and modulators thereof can be used to prognosticate, diagnose, inhibit, prevent, or alleviate one or more of these disorders.

TANGO 331

A cDNA clone (designated jthvb042g08) encoding at least a portion of human TANGO 331 protein was isolated from a human mammary epithelium cDNA library. A corresponding cDNA clone (designated jchrc045a03) was isolated from a human heart library. The human TANGO 331 protein is predicted by structural analysis to be a secreted protein.

The full length of the cDNA encoding human TANGO 331 protein (SEQ ID NO: 324) is 1432 nucleotide residues. The ORF of this cDNA, nucleotide residues 114 to 1172 of SEQ ID NO: 324 (i.e., SEQ ID NO: 325), encodes a 353-amino acid secreted protein (SEQ ID NO: 326).

The invention thus includes purified human TANGO 331 protein, both in the form of the immature 353 amino acid residue protein (SEQ ID NO: 326) and in the form of the mature, approximately 329 amino acid residue protein (SEQ ID NO: 328). Mature human TANGO 331 protein can be synthesized without the signal sequence polypeptide at the amino terminus thereof, or it can be synthesized by generating immature TANGO 331 protein and cleaving the signal sequence therefrom.

The invention includes nucleic acid molecules which encode a TANGO 331 polypeptide of the invention. Such nucleic acids include, for example, a DNA molecule having the nucleotide sequence listed in SEQ ID NO: 324 or some portion thereof, such as the portion which encodes mature TANGO 331 protein, immature TANGO 331 protein, or a domain of TANGO 331 protein. These nucleic acids are collectively referred to as TANGO 331 nucleic acids of the invention.

TANGO 331 proteins and nucleic acid molecules encoding them comprise a family of molecules having certain conserved structural and functional features, as indicated by the conservation of amino acid sequence between human TANGO 331 protein and the Chinese hamster (*Cricetulus griseus*) protein designated HT and having GenBank Accession number U48852, as shown in FIG. 49, and the conservation of nucleotide sequence between the ORFs encoding human TANGO 331 protein and Chinese hamster protein HT, as shown in FIGS. 50A-50E.

A common domain present in TANGO 331 proteins is a signal sequence. In one embodiment, a TANGO 331 protein contains a signal sequence corresponding to about amino acid residues 1 to 24 of SEQ ID NO: 326 (SEQ ID NO: 327). The signal sequence is cleaved during processing of the mature protein.

TANGO 331 proteins can include an extracellular domain. The human TANGO 331 protein is a secreted protein, and thus includes an 'extracellular domain' consisting of the entire mature protein (i.e., approximately residues 25 to 353 of SEQ ID NO: 326; SEQ ID NO: 328).

TANGO 331 proteins typically comprise a variety of potential post-translational modification sites (often within an extracellular domain), such as those described herein in Table XXII, as predicted by computerized sequence analysis of TANGO 331 proteins using amino acid sequence comparison software (comparing the amino acid sequence of TANGO 331 with the information in the PROSITE database {rel. 12.2; February 1995} and the Hidden Markov Models database {Rel. PFAM 3.3}). In certain embodiments, a protein of the invention has at least 1, 2, 4, 6, 10, 15, or 20 or more of the post-translational modification sites listed in Table XXII.

TABLE XXII

| Type of Potential Modification Site or Domain | Amino Acid Residues of SEQ ID NO: 326 | Amino Acid Sequence |
| --- | --- | --- |
| N-glycosylation site | 190 to 193 | NETH |
| | 251 to 254 | NGSY |
| cAMP- or cGMP-dependent protein kinase phosphorylation site | 26 to 29 | KKPT |
| Protein kinase C phosphorylation site | 48 to 50 | TAK |
| | 123 to 125 | TLK |
| | 144 to 146 | SQR |
| | 165 to 167 | SCR |
| | 187 to 189 | SLR |
| | 202 to 204 | SCK |
| | 210 to 212 | TNR |
| Casein kinase II phosphorylation site | 58 to 61 | TAWE |
| | 66 to 69 | SKYE |
| | 86 to 89 | SDFE |
| | 197 to 200 | TACD |
| | 210 to 213 | TNRD |
| | 255 to 258 | TCEE |
| | 295 to 298 | SLAE |
| | 339 to 342 | TEGE |
| | 349 to 352 | SRED |
| Tyrosine kinase phosphorylation site | 303 to 309 | RKNENCY |
| N-myristoylation site | 44 to 49 | GMVDTA |
| | 54 to 59 | GGGNTA |
| | 81 to 86 | GLCESS |
| | 150 to 155 | GNGHCS |
| | 158 to 163 | GSRQGD |
| | 164 to 169 | GSCRCH |
| | 252 to 257 | GSYTCE |
| | 313 to 318 | GSYVCV |
| Aspartic acid and asparagine hydroxylation site | 308 to 319 | |
| EGF-like domain cysteine pattern signature | 166 to 177 | |
| EGF domain | 140 to 177 | |
| | 234 to 263 | |
| | 301 to 330 | |
| Laminin-like EGF domain | 153 to 199 | |
| TNFR/NGFR cysteine-rich region domain | 180 to 214 | |
| Vertebrate metallothionein-like domain | 229 to 298 | |
| Leucine Zipper domain | 94 to 115 | |

Among the domains that occur in TANGO 331 protein are EGF domains, including a laminin-like EGF domain, a TNFR/NGFR cysteine-rich domain, a metallothionein-like domain, and a leucine zipper domain.

EGF-like domains are about 30 to 40 amino acid residues in length and comprise several conserved cysteine residues in one of several patterns. EGF-like domains occur in a large number of proteins including, for example, human epidermal growth factor (EGF), murine adipocyte differentiation inhibitor, human agrin, human growth factor amphiregulin, human growth factor betacellulin, sea urchin blastula tissue patterning proteins BP10 and Span, cattle tick glycoprotein BM86, human bone morphogenic protein 1, sea urchin suBMP, Drosophila tolloid protein, *Caenorhabditis elegans* developmental proteins lin-12 and glp-1, *C. elegans* tissue patterning protein APX-1, human calcium-dependent serine proteinase, human cartilage matrix protein, human cartilage oligomeric matrix protein, human cell surface antigen 114/A10, rat cell surface glycoprotein complex transmembrane subunit ASGP-2, human coagulation associated proteins C, Z, and S, human coagulation factors VII, IX, X, and XII, human complement components Clr, Cls, C6, C7, C8α, C8β, and C9, human complement-activating components of Ra-reactive factor, Drosophila epithelial development protein Crumbs, sea urchin exogastrula-inducing peptides A, C, D, and X, Drosophila cadherin-related tumor suppressor protein Fat, human fetal antigen 1 (a neuroendocrine differentiation protein derived from the delta-like protein), human fibrillins 1 and 2, sea urchin fibropellins IA, IB, IC, II, and III, human extracellular matrix proteins fibulin-1 and -2, Drosophila cell determination/axon guidance protein Argos, various poxvirus growth factor-related proteins, Drosophila developmental protein Gurken, human heparin-binding EGF-like growth factor, human transforming growth factor-α, human growth factors Lin-3 and Spitz, human hepatocyte growth factor activator, human LDL and VLDL receptors, human LDL receptor-related protein, human leukocyte antigen CD97, human cell surface glycoprotein EMRI, human cell surface glycoprotein F4/80, Japanese horseshoe crab limulus clotting factor C, mammalian membrane-bound endopeptidase Meprin A a subunit, murine milk fat globule-EGF factor 8, human glial growth factors neuregulin GGF-I and GGF-II, mammalian neurexins, human neurogenic proteins Notch, Xotch, Tan-1, and Delta, *C. elegans* differentiation protein Lag-2, Drosophila differentiation proteins Serrate and Slit, chordate basement membrane protein Nidogen, Plasmodium ookinete 24, 25, and 28 kilodalton surface proteins, human pancreatic secretory granule membrane glycoprotein GP2, human non-specific cell lysis protein Perforin, human proteoglycans aggrecan, versican, perlecan, brevican, and chondroitin sulfate, human endoplasmic reticulum prostaglandin G/H synthases 1 and 2, human extracellular protein S1-5, human autocrine growth factor Schwannoma-derived growth factor, human E-, P—, and L-selectins, *Arabidopsis thaliana* chlorophyll complex assembly protein serine/threonine-protein kinase homolog, guinea pig sperm-egg fusion proteins PH-30α and β, murine stromal cell derived protein-1, human teratocarcinoma-derived growth factor, mammalian extracellular protein tenascin, chicken extracellular protein TEN-A, human tenascin-X, Drosophila tenascin-like proteins TEN-A and TEN-M, human protein C activator thrombomodulin, human adhesive glycoproteins thrombospondins 1, 2, 3, and 4, human thyroid peroxidases 1 and 2, human transforming growth factor β-1 binding protein, human tyrosine-protein kinase receptors Tek and Tie, human urokinase-type plasminogen activator, human tissue plasminogen activator, human uromodulin, human vitamin K-dependent anticoagulant proteins C and S (and the related human single-chain plasma glycoprotein Z), the sea urchin 63 kilodalton sperm flagellar membrane protein, chicken Nel protein, and the hypothetical *C. Elegans* protein T20G5.3. Although these proteins have a variety of activities and sites of expression, a common characteristic of most of them is that they are involved in protein-to-protein binding in the extracellular space—either to a secreted protein, a component of the extracellular matrix, or to an extracellular portion of an integral membrane protein. Based on this shared characteristic, the presence of multiple EGF-like domains in TANGO 331 indicates that TANGO 331 is involved in binding to proteins extracellularly.

Post-translational hydroxylation of aspartic acid or asparagine to form erythro-β-hydroxyaspartic acid or erythro-β-hydroxyasparagine occurs in various proteins having one or more EGF-like domains (e.g., blood coagulation protein factors VII, IX, and X, blood coagulation proteins C, S, and Z, the LDL receptor, thrombomodulin, and the like). TANGO 331 has a signature sequence which is characteristic of hydroxylation of the asparagine residue at amino acid residue 310. The invention thus includes TANGO 331 proteins having a hydroxylated asparagine residue at position 310 of SEQ ID NO: 326.

TNFR/NGFR (tumor necrosis factor receptor/nerve growth factor receptor) cysteine-rich region domains are about 30 to 40 amino acid residues in length, and generally exhibit a conserved pattern of six or more cysteine residues. These domains occur in several soluble and transmembrane proteins which are known to be receptors for growth factors or for cytokines. Examples of TNFR/NGFR cysteine-rich region domain-containing proteins are human tumor necrosis factor (TNF) cysteine-rich region domains type I and type II receptors, Shope fibroma virus soluble TNF receptor, human lymphotoxin α/β, human low-affinity nerve growth factor receptor, human CD40L (cytokine) receptor CD40, human CD27L (cytokine) receptor CD27, human CD30L (cytokine) receptor CD30, human T-cell cytokine receptor 4-1BB, human apoptotic FASL protein receptor FAS, human T-cell OX40L (cytokine) receptor OX40, human apoptosis-related receptor Wsl-1, and Vaccinia protein A53. Presence of a TNFR/NGFR cysteine-rich region domain in TANGO 331 is an indication that TANGO 331 is involved in one or more physiological processes involving extracellular binding with a cytokine or growth factor. Such processes include, for example, growth, homeostasis, regeneration, and proliferation of cells and tissues, immune (including autoimmune) responses, host defenses against infection, and the like.

Metallothioneins are cysteine-rich proteins which are capable of binding heavy metals such as calcium, zinc, copper, cadmium, cobalt, nickel, and the like. Proteins which have a domain which resembles a metal-binding domain of a metallothionein are also capable of binding such metals. TANGO 331 comprises a metallothionein-like domain, and is capable of binding one or more heavy metals. This is an indication that TANGO 331 is involved in one or more physiological processes which involve metal binding. Such processes include, by way of example and not limitation, nutritional supply of metals to cells on a controlled basis, removal of toxic metal species from body tissues, storage of metals, and the like.

TANGO 331 comprises a leucine zipper region at about amino acid residue 94 to about amino acid residue 115 (i.e., 94 LeaqeehLeawwlqLkseypdL 115; SEQ ID NO: 460). Leucine zipper regions are known to be involved in dimerization of proteins. Leucine zipper regions interact with one another, leading to formation of homo- or hetero-dimers between proteins, depending on their identity. The presence in TANGO 331 of a leucine zipper region is a further indication that this protein is involved in protein-protein interactions.

TANGO 331 shares amino acid and nucleic acid homology with a Chinese hamster protein designated HT, and thus is involved in corresponding physiological processes in humans. An alignment of the amino acid sequences of (human) TANGO 331 and Chinese hamster protein HT is shown in FIG. 23E. In this alignment (made using the ALIGN software {Myers and Miller (1989) CABIOS, ver. 2.0}; pam120.mat scoring matrix; gap opening penalty=12, gap extension penalty=4), the proteins are 71.9% identical. An alignment of the nucleotide sequences of the ORFs encoding (human) TANGO 331 and Chinese hamster protein HT is shown in FIGS. 50A-50E. The two ORFs are 74.5% identical, as assessed using the same software and parameters.

The signal peptide prediction program SIGNALP (Nielsen et al. (1997) Protein Engineering 10:1-6) predicted that human TANGO 331 protein includes an approximately 24 (i.e., 22, 23, 24, 25, or 26) amino acid residue signal peptide (amino acid residues 1 to 24 of SEQ ID NO: 326; SEQ ID NO: 327) preceding the mature TANGO 331 protein (i.e., approximately amino acid residues 25 to 353 of SEQ ID NO: 326; SEQ ID NO: 328). Mature human TANGO 331 is a secreted protein.

FIG. 48 depicts a hydrophobicity plot of human TANGO 331 protein. Relatively hydrophobic regions are above the dashed horizontal line, and relatively hydrophilic regions are below the dashed horizontal line. The hydrophobic region which corresponds to amino acid residues 1 to 24 of SEQ ID NO: 326 is the signal sequence of human TANGO 331 (SEQ ID NO: 327). As described elsewhere herein, relatively hydrophilic regions are generally located at or near the surface of a protein, and are more frequently effective immunogenic epitopes than are relatively hydrophobic regions. For example, the region of human TANGO 331 protein from about amino acid residue 140 to about amino acid residue 170 appears to be located at or near the surface of the protein, while the region from about amino acid residue 115 to about amino acid residue 130 appears not to be located at or near the surface.

The predicted molecular weight of human TANGO 331 protein without modification and prior to cleavage of the signal sequence is about 38.2 kilodaltons. The predicted molecular weight of the mature human TANGO 331 protein without modification and after cleavage of the signal sequence is about 35.6 kilodaltons.

Tissue distribution of TANGO 331 mRNA was determined by Northern blot hybridization. Northern blot hybridizations with the various RNA samples were performed using standard Northern blotting conditions and washing under stringent conditions (i.e., 0.2×SSC at 65° C.). The DNA probe used in the Northern Blot experiments was radioactively labeled with $^{32}$P-dCTP using the PRIME-IT™ kit (Stratagene, La Jolla, Calif.) according to the instructions of the supplier. Filters having human mRNA disposed thereon (MULTITISSUE™ Northern I and MULTITISSUE™ Northern II obtained from Clontech, Palo Alto, Calif.) were probed in EXPRESSHYB™ hybridization solution (Clontech) and washed at high stringency according to the manufacturer's recommendations.

Two isoforms of human TANGO 331 were identified using this Northern blot analysis, indicating that TANGO 331 can have a splice variant. One isoform (corresponding to the larger message) can be a transmembrane protein (frizzled-like) and the other (i.e., smaller) isoform can be a secreted form. The two isoforms exhibit a clear pattern of tissue specificity. On the multiple tissue blot from Clonetech, the large transcript is found in almost all tissues, whereas the smaller message is expressed mainly in heart, skeletal muscle, placenta, and pancreas tissues.

TANGO 331 can be expressed as a recombinant glutathione-S-transferase (GST) fusion polypeptide in E. coli and the fusion polypeptide is isolated and characterized. Specifically, TANGO 331 can be fused with GST and this fusion polypeptide can expressed in E. coli, e.g., in strain PEBI99. Expression of the GST-TANGO 331 fusion protein in PEB199 is induced with IPTG. The recombinant fusion polypeptide can be purified from crude bacterial lysates of the induced PEB199 strain by affinity chromatography, e.g., using glutathione-substituted beads. Using polyacrylamide gel electrophoretic analysis of the polypeptide purified from the bacterial lysates, the molecular weight of the resultant fusion polypeptide can be determined.

To express the TANGO 331 gene in COS cells, the pcDNA/Amp vector by Invitrogen Corporation (San Diego, Calif.) can be used. This vector contains an SV40 origin of replication, an ampicillin resistance gene, an E. coli replication origin, a CMV promoter followed by a polylinker region, and an SV40 intron and polyadenylation site. A DNA fragment encoding the entire TANGO 331 protein and an HA tag (Wilson et al. (1984) Cell 37:767) or a FLAG tag fused in-frame to its 3' end of the fragment can be cloned into the polylinker region of the vector, thereby placing the expression of the recombinant protein under the control of the CMV promoter.

To construct the plasmid, the TANGO 331 DNA sequence is amplified by PCR using two primers. The 5' primer contains the restriction site of interest followed by approximately twenty nucleotides of the TANGO 331 coding sequence starting from the initiation codon; the 3' end sequence contains complementary sequences to the other restriction site of interest, a translation stop codon, the HA tag or FLAG tag and the last 20 nucleotides of the TANGO 331 coding sequence. The PCR amplified fragment and the pcDNA/Amp vector are digested with the appropriate restriction enzymes and the vector is dephosphorylated using the CIAP enzyme (New England Biolabs, Beverly, Mass.). Preferably the two restriction sites chosen are different so that the TANGO 331 gene is inserted in the correct orientation. The ligation mixture is transformed into E. coli cells (e.g., one or more of strains HB101, DH5a, SURE, available from Stratagene Cloning Systems, La Jolla, Calif.), the transformed culture is plated on ampicillin media plates, and resistant colonies are selected. Plasmid DNA is isolated from transformants and examined by restriction analysis for the presence of the correct fragment.

COS cells are subsequently transfected using the TANGO 331-pcDNA/Amp plasmid DNA using the calcium phosphate or calcium chloride co-precipitation methods, DEAE-dextran-mediated transfection, lipofection, or electroporation. Other suitable methods of transfecting host cells can be found in Sambrook, J., Fritsh, E. F., and Maniatis, T. Molecular Cloning: A Laboratory Manual. 2nd, ed., Cold Spring Harbor Laboratory, Cold Spring Harbor Laboratory Press, Cold Spring Harbor, N.Y., 1989. The expression of the TANGO 331 polypeptide can be detected by radiolabelling ($^{35}$S-methionine or $^{35}$S-cysteine available from NEN, Boston, Mass., can be used) and immunoprecipitation (Harlow, E. and Lane, D. Antibodies: A Laboratory Manual, Cold Spring Harbor Laboratory Press, Cold Spring Harbor, N.Y., 1988) using an HA specific monoclonal antibody. Briefly, the cells are labeled for 8 hours with $^{35}$S-methionine (or $^{35}$S-cysteine). The culture media are then collected and the cells are lysed using detergents (RIPA buffer, 150 millimolar NaCl, 1% NP-40, 0.1% SDS, 0.5% DOC, 50 millimolar Tris, pH 7.5). Both the cell lysate and the culture media are precipitated with an HA specific monoclonal antibody. Precipitated polypeptides are then analyzed by SDS-PAGE.

Alternatively, DNA containing the TANGO 331 coding sequence can be cloned directly into the polylinker of the pCDNA/Amp vector using the appropriate restriction sites. The resulting plasmid is transfected into COS cells in the manner described above, and the expression of the TANGO 331 polypeptide can be detected by radiolabelling and immunoprecipitation using an TANGO 331 specific monoclonal antibody.

The human TANGO 331 gene was mapped using the Genebridge 4 Human Radiation hybrid mapping panel with ATTATTCAGAAGGATGTCCCGTGG (SEQ ID NO: 369) as the forward primer and CCTCCTGATTACCTACAATG-GTC (SEQ ID NO: 370) as the reverse primer. The human TANGO 331 gene maps to human 22q11-q13. Flanking markers for this region are WI-4572 and WI-8917. The schizophrenia 4 (sczd4) locus also maps to this region of the human chromosome. Also mapping to this region of the human chromosome are the following genes: transcription factor 20 (tcf20), Benzodiazepine receptor, peripheral type (bzrp), Arylsulfatase A (arsa), diaphorase (NADH); cytochrome b-5 reductase (dia1), and Solute carrier family 5 (sodium/glucose transporter), member 1 (slca1). This region is syntenic to mouse chromosome 15. The stargazer (stg), gray tremor (gt), brachyury modifier 2 (Brm2), bronchial hyperresponsiveness 2 (Bhr2), loss of righting induced by ethanol 5 (Lore5), fluctuating asymmetry QTL 8 (Faq8), jerky (Jrk), belted (bt), and koala (Koa) loci also map to this region of the mouse chromosome, several of which are neuromuscular related.

Uses of TANGO 331 Nucleic Acids,

Polypeptides, and Modulators Thereof

TANGO 331 proteins are involved in disorders which affect both tissues in which they are normally expressed and tissues in which they are normally not expressed. Based on the observation that TANGO 331 is expressed in human mammary epithelial tissue and human heart tissue, TANGO 331 protein is involved in one or more biological processes which occur in mammary epithelial tissue, in other epithelial tissues, and in heart tissue. In particular, TANGO 331 is involved in modulating growth, proliferation, survival, differentiation, and activity of cells including, but not limited to, epithelial cells (e.g., mammary epithelial cells) of the animal in which it is normally expressed. Thus, TANGO 331 has a role in disorders which affect these cells and their growth, proliferation, survival, differentiation, and activity. TANGO 331 is therefore involved in physiological processes such as maintenance of epithelia, carcinogenesis, modulation and storage of protein factors and metals, and lactation. Furthermore, because TANGO 331 is expressed in human mammary epithelial cells, it also has a role in nutrition of human infants (e.g., providing nutrients such as minerals to infants and providing protein factors not synthesized by infants) and in disorders which affect them. Thus, TANGO 331 is involved in a number of disorders such as breast cancer, insufficient lactation, infant nutritional and growth disorders, and the like. TANGO 331 polypeptides, nucleic acids, or modulators thereof can be used to prognosticate, diagnose, inhibit, prevent, or alleviate one or more of these disorders.

Because TANGO 331 exhibits expression in the heart, TANGO 331 nucleic acids, proteins, and modulators thereof can be used to treat cardiovascular disorders. Examples of cardiovascular disorders with which TANGO 331 can be involved include those described elsewhere in this disclosure. TANGO 331 polypeptides, nucleic acids, or modulators thereof can be used to prognosticate, diagnose, inhibit, prevent, or alleviate one or more of these disorders.

In another example, TANGO 331 polypeptides, nucleic acids, and modulators thereof, can be involved in normal and aberrant functioning of skeletal muscle tissue, and can thus be involved in disorders of such tissue. Examples of skeletal muscle disorders are described elsewhere in this disclosure. TANGO 331 polypeptides, nucleic acids, or modulators thereof can be used to prognosticate, diagnose, inhibit, prevent, or alleviate one or more of these disorders.

In another example, TANGO 331 polypeptides, nucleic acids, and modulators thereof can be used to treat placental disorders, such as those described elsewhere in this disclosure. TANGO 331 polypeptides, nucleic acids, or modulators thereof can be used to prognosticate, diagnose, inhibit, prevent, or alleviate one or more of these disorders.

Presence in TANGO 331 of numerous EGF-like domains, including the laminin-like EGF-like domain indicates that TANGO 331 is involved in extracellular binding of proteins, including both other secreted proteins (e.g., growth factors and cytokines) and cell-surface proteins. Binding of TANGO 331 to other secreted proteins modulates their activity, their rate of uptake by cells, and their rate of degradation. Binding of TANGO 331 to cell surface proteins modulates their activity, including, for example, their ability to bind with other secreted proteins, and transmits a signal to the cell expressing the cell-surface protein. Presence in TANGO 331 of a TNFR/NGFR cysteine-rich region domain is further indicative of the ability of TANGO 331 to bind with growth factors and cytokines. Thus, TANGO 331 is involved in a number of proliferative and immune disorders including, but not limited to, cancers (e.g., breast cancer), autoimmune disorders, insufficient or inappropriate host responses to infection, acquired immune deficiency syndrome, and the like. TANGO 331 polypeptides, nucleic acids, or modulators thereof can be used to prognosticate, diagnose, inhibit, prevent, or alleviate one or more of these disorders.

The fact that TANGO 331 has a metallothionein-like region is indicative of the ability of TANGO 331 to bind with metal ions, including nutritionally required metal ions (e.g., calcium, magnesium, zinc, manganese, cobalt, iron, and the like). Thus, TANGO 331 is involved in binding with essential minerals and in delivering them to their proper body locations. TANGO 331 is also involved in binding excess or toxic metal ions so that they can be excreted. TANGO 331 is thus involved in disorders involving insufficient or inappropriate localization of metal ions. Such disorders include, but are not limited to, malnutrition and mineral deficiency disorders, hemochromatosis, inappropriate calcification of body tissues, bone disorders such as osteoporosis, and the like. TANGO 331 polypeptides, nucleic acids, or modulators thereof can be used to prognosticate, diagnose, inhibit, prevent, or alleviate one or more of these disorders.

Mapping of the human TANGO 331 gene to chromosomal region 22q11-q13 is an indication of disorders with which its expression (or non- or aberrant-expression) can be associated. For example, arylsulfatase A is associated with Metachromatic leukodystrophy. Diaphorase (NADH:cytochrome b-5 reductase) is associated with methemoglobinemia, types I and II. Solute carrier family 5 (sodium/glucose transporter), member 1 is associated with glucose/galactose malabsorption. The gene designated schizophrenia 4 is associated with schizophrenia and velocardiofacial syndrome, as described in Online Mendelian Inheritance in Man, Johns Hopkins University, Baltimore, Md. MIM Number: 600850:12/7/98. These mapping data indicate that TANGO 331 polypeptides, nucleic acids, and modulators thereof can be used to prognosticate, diagnose, inhibit, prevent, or alleviate one or more of these disorders.

TANGO 332

A cDNA clone (designated jlhbab463g12) encoding at least a portion of human TANGO 332 protein was isolated from a human adult brain cDNA library. The human TANGO 332 protein is predicted by structural analysis to be a secreted protein.

The full length of the cDNA encoding human TANGO 332 protein (SEQ ID NO: 329) is 2730 nucleotide residues. The ORF of this cDNA, nucleotide residues 173 to 2185 of SEQ ID NO: 329 (i.e., SEQ ID NO: 330), encodes a 671-amino acid transmembrane protein (SEQ ID NO: 331).

The invention thus includes purified human TANGO 332 protein, both in the form of the immature 671 amino acid residue protein (SEQ ID NO: 331) and in the form of the mature, approximately 649 amino acid residue protein (SEQ ID NO: 333). Mature human TANGO 332 protein can be synthesized without the signal sequence polypeptide at the amino terminus thereof, or it can be synthesized by generating immature TANGO 332 protein and cleaving the signal sequence therefrom.

The invention includes nucleic acid molecules which encode a TANGO 332 polypeptide of the invention. Such nucleic acids include, for example, a DNA molecule having the nucleotide sequence listed in SEQ ID NO: 329 or some portion thereof, such as the portion which encodes mature TANGO 332 protein, immature TANGO 332 protein, or a domain of TANGO 332 protein. These nucleic acids are collectively referred to as TANGO 332 nucleic acids of the invention.

TANGO 332 proteins and nucleic acid molecules encoding them comprise a family of molecules having certain conserved structural and functional features, as indicated by the conservation of amino acid sequence between human TANGO 332 protein, human brain-enriched hyaluronan-binding factor (BEF), as shown in FIGS. 52A-52B, and murine brevican protein, as shown in FIGS. 53A-53C. This conservation is further indicated by conservation of nucleotide sequence between the ORFs encoding human TANGO 332 protein and murine brevican protein, as shown in FIGS. 54A-54J.

A common domain present in TANGO 332 proteins is a signal sequence. In one embodiment, a TANGO 332 protein contains a signal sequence corresponding to about amino acid residues 1 to 22 of SEQ ID NO: 331 (SEQ ID NO: 332). The signal sequence is cleaved during processing of the mature protein.

TANGO 332 proteins are secreted proteins. The mature form of human TANGO 332 protein has the amino acid sequence of approximately amino acid residues 23 to 671 of SEQ ID NO: 331.

TANGO 332 proteins typically comprise a variety of potential post-translational modification sites (often within an extracellular domain), such as those described herein in Table XXIII, as predicted by computerized sequence analysis of TANGO 332 proteins using amino acid sequence comparison software (comparing the amino acid sequence of TANGO 332 with the information in the PROSITE database {rel. 12.2; February 1995} and the Hidden Markov Models database {Rel. PFAM 3.3}). In certain embodiments, a protein of the invention has at least 1, 2, 4, 6, 10, 15, or 20 or more of the post-translational modification sites listed in Table XXII.

TABLE XXIII

| Type of Potential Modification Site or Domain | Amino Acid Residues of SEQ ID NO: 331 | Amino Acid Sequence |
|---|---|---|
| N-glycosylation site | 130 to 133 | NDSG |
|  | 337 to 340 | NQTG |
| Protein kinase C phosphorylation site | 67 to 69 | SRR |
|  | 74 to 76 | SPR |
|  | 165 to 167 | SAR |
|  | 212 to 214 | TVR |

TABLE XXIII-continued

| Type of Potential Modification Site or Domain | Amino Acid Residues of SEQ ID NO: 331 | Amino Acid Sequence |
|---|---|---|
| | 219 to 221 | TPR |
| | 310 to 312 | SVR |
| | 319 to 321 | SQR |
| | 545 to 547 | TPR |
| | 615 to 617 | SGR |
| Casein kinase II phosphorylation site | 29 to 32 | SSED |
| | 116 to 119 | SLTD |
| | 219 to 222 | TPRE |
| | 269 to 272 | TLEE |
| | 382 to 385 | TVTE |
| | 386 to 389 | TLEE |
| | 397 to 400 | TESE |
| | 419 to 422 | STPE |
| | 430 to 433 | TLLE |
| | 446 to 449 | SEEE |
| | 545 to 548 | TPRE |
| | 558 to 561 | TLVE |
| Tyrosine kinase phosphorylation site | 128 to 135 | RPNDSGIY |
| | 451 to 459 | KALEEEEKY |
| N-myristoylation site | 47 to 52 | GVLGGA |
| | 133 to 138 | GIYRCE |
| | 142 to 147 | GIDDSS |
| | 174 to 179 | GAQEAC |
| | 183 to 188 | GAHIAT |
| | 281 to 286 | GAEIAT |
| | 288 to 293 | GQLYAA |
| | 297 to 302 | GLDHCS |
| | 324 to 329 | GGLPGV |
| | 403 to 408 | GAIYSI |
| | 414 to 419 | GGGGSS |
| | 576 to 581 | GVPRGE |
| | 586 to 591 | GSSEGA |
| Immunoglobulin-/major histocompatibility protein-like (Ig-/MHC-like) domain | 50 to 141 | |
| Extracellular link domain | 156 to 251 | |
| | 257 to 353 | |

Among the domains that occur in TANGO 332 protein are an Ig-/MHC-like domain and a pair of extracellular link domains. In one embodiment, the protein of the invention has at least one domain that is at least 55%, preferably at least about 65%, more preferably at least about 75%, yet more preferably at least about 85%, and most preferably at least about 95% identical to one of these domains. In other embodiments, the protein has at least one Ig-/MHC-like domain and one extracellular link domain described herein in Table XXIII. In other embodiments, the protein has at least one Ig-/MHC-like domain and at least two extracellular link domains.

Ig-/MHC-like domains are conserved among immunoglobulin (Ig) constant (CL) regions and one of the three extracellular domains of major histocompatibility proteins (MHC). The presence in TANGO 332 of an Ig-/MHC-like domain indicates that the corresponding region of TANGO 332 is structurally similar to this conserved extracellular region.

Extracellular link domains occur in hyaluronan-(HA-) binding proteins. Proteins having this domain include cartilage link protein, proteoglycans such as aggrecan, brevican, neurocan, and versican, CD44 antigen (the primary cell surface receptor for HA), and tumor necrosis factor-inducible protein TSG-6. Presence of a pair of extracellular link domains in TANGO 332 indicates that this protein is also involved in HA-binding, and therefore is involved in physiological processes such as cartilage (and other tissue) organization, extracellular matrix organization, neural growth and branching, and cell-to-cell and cell-to-matrix interactions. Involvement of TANGO 332 in these processes implicates this protein in disorders such as tumor growth and metastasis, movement of cells (e.g., leukocytes) through extracellular matrix, inappropriate inflammation, and the like.

Brevican is a murine nervous system-specific chondroitin sulfate proteoglycan which binds in a calcium-dependent manner with two classes of sulfated glycolipids, namely sulfatides and HNK-1-reactive sulfoglucuronylglycolipids (Miura et al. (1999) J. Biol. Chem. 274:11431-11438). A human orthologue, designated BEF ('Brain-Enriched hyaluronan-binding Factor'), of murine brevican is expressed by human glioma cells, but not by brain tumors of non-glial origin (P.C.T. application publication number W098/31800; Zhang et al. (1998) J. Neurosci. 18:2370-2376). Those authors suggested that cleavage of that human orthologue mediates glioma cell invasion in vivo.

An alignment of the amino acid sequences of TANGO 332 and BEF protein is shown in FIGS. 52A-52B. In this alignment (made using the ALIGN software {Myers and Miller (1989) CABIOS, ver. 2.0}; pam120.mat scoring matrix; gap opening penalty=12, gap extension penalty=4), the proteins are 75.7% identical, although it is seen that TANGO 332 includes two domains (one from about amino acid residue 152 to about residue 208, and the other near the carboxyl terminus of TANGO 332) which do not occur in BEF protein. It is likely that these two regions account for the differences between the physiological roles of TANGO 332 and BEF.

An alignment of the amino acid sequences of (human) TANGO 332 and murine brevican protein is shown in FIGS. 53A-53C. In this alignment (made using the ALIGN software {Myers and Miller (1989) CABIOS, ver. 2.0}; pam120.mat scoring matrix; gap opening penalty=12, gap extension penalty=4), the proteins are 75.5% identical, although it is seen that murine brevican protein includes a domain which does not occur in TANGO 332 protein, this domain is present from about amino acid residue 626 to the carboxyl terminus of murine brevican protein. An alignment of the nucleotide sequences of the ORFs encoding (human) TANGO 332 and murine brevican protein is shown in FIGS. 54A-54J. The two ORFs are 62.6% identical, as assessed using the same software and parameters.

TANGO 332 exhibits many of the same properties as BEF. TANGO 332 is also related to murine brevican protein, and thus is involved with corresponding physiological processes (i.e., such as those described above) in humans. For example, TANGO 332 modulates intracellular binding and migration of cells in a tissue or extracellular matrix. However, the absence from BEF of one of the two extracellular link domains present in TANGO 332 indicates that one or more of the subunit structure, the tissue specificity, and the binding specificity of TANGO 332 and BEF proteins differ. Thus, TANGO 332 is involved in many of the physiological processes and disorders in which BEF protein is involved. Like murine brevican and other proteoglycans, TANGO 332 acts in vivo as a tissue organizing protein, influences growth and maturation of tissues in which it is expressed, modulates growth factor-mediated activities, modulates structural features of tissues (e.g., collagen fibrillogenesis), modulates tumor cell growth and invasivity, and influences neurite growth and branching.

The signal peptide prediction program SIGNALP (Nielsen et al. (1997) Protein Engineering 10:1-6) predicted that human TANGO 332 protein includes an approximately 22 (i.e., 20, 21, 22, 23, or 24) amino acid residue signal peptide (amino acid residues 1 to 22 of SEQ ID NO: 331; SEQ ID NO: 332) preceding the mature TANGO 332 protein (i.e., approximately amino acid residues 23 to 671 of SEQ ID NO: 331;

SEQ ID NO: 333). Human TANGO 332 protein is a secreted protein, as assessed using the secretion assay described herein. Secreted TANGO 332 proteins having approximate sizes of 148 kilodaltons and 100 kilodaltons could be detected using this assay.

FIG. 51 depicts a hydrophobicity plot of human TANGO 332 protein.

Relatively hydrophobic regions are above the dashed horizontal line, and relatively hydrophilic regions are below the dashed horizontal line. The hydrophobic region which corresponds to amino acid residues 1 to 22 of SEQ ID NO: 331 is the signal sequence of human TANGO 332 (SEQ ID NO: 332). As described elsewhere herein, relatively hydrophilic regions are generally located at or near the surface of a protein, and are more frequently effective immunogenic epitopes than are relatively hydrophobic regions. For example, the region of human TANGO 332 protein from about amino acid residue 445 to about amino acid residue 475 appears to be located at or near the surface of the protein, while the region from about amino acid residue 45 to about amino acid residue 62 appears not to be located at or near the surface.

The predicted molecular weight of human TANGO 332 protein without modification and prior to cleavage of the signal sequence is about 71.7 kilodaltons. The predicted molecular weight of the mature human TANGO 332 protein without modification and after cleavage of the signal sequence is about 69.5 kilodaltons.

Uses of TANGO 332 Nucleic Acids,
Polypeptides, and Modulators Thereof

TANGO 332 proteins are involved in disorders which affect both tissues in which they are normally expressed and tissues in which they are normally not expressed. Based on the observation that TANGO 332 is expressed in human adult brain tissue, TANGO 332 protein is involved in one or more biological processes which occur in these tissues. In particular, TANGO 332 is involved in modulating growth, proliferation, survival, differentiation, and activity of cells including, but not limited to, adult brain cells of the animal in which it is normally expressed. Thus, TANGO 332 has a role in disorders which affect these cells and their growth, proliferation, survival, differentiation, interaction, and activity. Examples of such disorders include, by way of example and not limitation, disorders of neural connection establishment or maintenance, impaired cognitive function, dementia, senility, Alzheimer's disease, mental retardation, brain tumors (e.g., gliomas such as astrocytomas, endophytic and exophytic retinoblastomas, ependymomas, gangliogliomas, mixed gliomas, nasal gliomas, optic gliomas, and Schwannomas, and other brain cell tumors such as medulloblastomas, pituitary adenomas, teratomas, etc.), and the like. TANGO 332 can also be involved in the other brain disorders described elsewhere in this disclosure.

Homology of human TANGO 332 with murine brevican protein and with human brevican homolog BEF indicates that TANGO 332 has physiological functions in humans analogous to the functions of these proteins. Brevican is a member of the aggrecan/versican family of proteoglycans, and has a hyaluronic acid-binding domain in its amino terminal region and a lectin-like domain in its carboxyl terminal region. Expression of brevican is highly specific to brain tissue, and increases as the mammalian brain develops. Thus, brevican is involved in maintaining the extracellular environment of mature brain tissue and is a constituent of adult brain extracellular matrix. TANGO 332 is involved in modulating cell-to-cell adhesion, tissue and extracellular matrix invasivity of cells, and the like. Thus, TANGO 332 is involved in disorders in which these physiological processes are relevant. Such disorders include, for example, loss of control of cell growth, tumor metastasis, malformation of neurological connections, inflammation, immune and autoimmune responses, and the like.

In addition, presence in TANGO 332 of extracellular link domains indicates that this protein is involved in physiological processes involving structure and function of extracellular matrices and interaction of cells with such matrices and with each other. This is further evidence that TANGO 332 is involved in disorders such as inappropriate inflammation, tumor metastasis, inappropriate leukocyte extravasation, localization, and reactivity, and the like.

TANGO 332-related molecules can be used to modulate one or more of the activities in which TANGO 332 is involved and can also be used to prevent, diagnose, or treat one or more of the disorders in which TANGO 332 is involved.

TANGO 202

A cDNA clone (designated jthke096b05) encoding at least a portion of human TANGO 202 protein was isolated from a human fetal skin cDNA library. The corresponding murine cDNA was isolated as a clone (designated jtmMa044f07) from a bone marrow stromal cell cDNA library. The human TANGO 202 protein is predicted by structural analysis to be a type I membrane protein, although it can exist in a secreted form as well. The murine TANGO 202 protein is predicted by structural analysis to be a secreted protein.

The full length of the cDNA encoding human TANGO 202 protein (SEQ ID NO: 371) is 1656 nucleotide residues. The open reading frame (ORF) of this cDNA, nucleotide residues 34 to 1458 of SEQ ID NO: 371 (i.e., SEQ ID NO: 372), encodes a 475-amino acid transmembrane protein (SEQ ID NO: 373).

The invention thus includes purified human TANGO 202 protein, both in the form of the immature 475 amino acid residue protein (SEQ ID NO: 373) and in the form of the mature 456 amino acid residue protein (SEQ ID NO: 375). The invention also includes purified murine TANGO 202 protein, both in the form of the immature 470 amino acid residue protein (SEQ ID NO: 439) and in the form of the mature 451 amino acid residue protein (SEQ ID NO: 413). Mature human or murine TANGO 202 proteins can be synthesized without the signal sequence polypeptide at the amino terminus thereof, or they can be synthesized by generating immature TANGO 202 protein and cleaving the signal sequence therefrom.

The invention includes nucleic acid molecules which encode a polypeptide of the invention. Such nucleic acids include, for example, a DNA molecule having the nucleotide sequence listed in SEQ ID NO: 371 or some portion thereof or SEQ ID NO: 439 or some portion thereof, such as the portion which encodes mature human or murine TANGO 202 protein, immature human or murine TANGO 202 protein, or a domain of human or murine TANGO 202 protein. These nucleic acids are collectively referred to as nucleic acids of the invention.

TANGO 202 proteins and nucleic acid molecules encoding them comprise a family of molecules having certain conserved structural and functional features.

A common domain present in TANGO 202 proteins is a signal sequence. In one embodiment, a TANGO 202 protein contains a signal sequence corresponding to amino acid residues 1 to 19 of SEQ ID NO: 373 (SEQ ID NO: 374) or to amino acid residues 1 to 19 of SEQ ID NO: 439 (SEQ ID NO: 412). The signal sequence is cleaved during processing of the mature protein.

TANGO 202 proteins can also include an extracellular domain. The human TANGO 202 protein extracellular domain is located from about amino acid residue 20 to about amino acid residue 392 of SEQ ID NO: 373 in the non-secreted form, and from about amino acid residue 20 to amino acid residue 475 of SEQ ID NO: 373 (i.e., the entire mature human protein). The murine TANGO 202 protein extracellular domain is located from about amino acid residue 20 to amino acid residue 470 of SEQ ID NO: 439 (i.e., the entire mature murine protein).

TANGO 202 proteins of the invention can also include a transmembrane domain. As used herein, a "transmembrane domain" refers to an amino acid sequence having at least about 20 to 25 amino acid residues in length and which contains at least about 65-70% hydrophobic amino acid residues such as alanine, leucine, phenylalanine, protein, tyrosine, tryptophan, or valine. In a preferred embodiment, a transmembrane domain contains at least about 15 to 30 amino acid residues, preferably about 20-25 amino acid residues, and has at least about 60-80%, more preferably 65-75%, and more preferably at least about 70% hydrophobic residues. Thus, in one embodiment, a TANGO 202 protein of the invention contains a transmembrane domain corresponding to about amino acid residues 393 to 415 of SEQ ID NO: 373 (SEQ ID NO: 377).

In addition, TANGO 202 proteins of the invention can include a cytoplasmic domain, particularly including a carboxyl-terminal cytoplasmic domain. The cytoplasmic domain is located from about amino acid residue 416 to amino acid residue 475 of SEQ ID NO: 373 (SEQ ID NO: 378) in the non-secreted form of human TANGO 202 protein.

TANGO 202 proteins typically comprise a variety of potential post-translational modification sites (often within an extracellular domain), such as those described herein in Tables XXIV (for human TANGO 202) and XXV (for murine TANGO 202), as predicted by computerized sequence analysis of TANGO 202 proteins using amino acid sequence comparison software (comparing the amino acid sequence of TANGO 202 with the information in the PROSITE database {rel. 12.2; February 1995} and the Hidden Markov Models database {Rel. PFAM 3.3}).

TABLE XXIV

| Type of Potential Modification Site or Domain | Amino Acid Residues of SEQ ID NO: 373 | Amino Acid Sequence |
|---|---|---|
| N-glycosylation site | 47 to 50 | NWTA |
| | 61 to 64 | NETF |
| | 219 to 222 | NYSA |
| | 295 to 298 | NVSL |
| | 335 to 338 | NQTV |
| | 347 to 350 | NLSV |
| Protein kinase C phosphorylation site | 70 to 72 | TLK |
| | 137 to 139 | TSK |
| | 141 to 143 | SNK |
| | 155 to 157 | SQR |
| | 238 to 240 | TGR |
| | 245 to 247 | TIR |
| | 277 to 279 | THR |
| | 307 to 309 | SDR |
| | 355 to 357 | SSK |
| | 387 to 389 | SHR |
| | 418 to 420 | TFK |
| | 421 to 423 | SHR |
| Casein kinase II phosphorylation site | 337 to 340 | TVAE |
| | 438 to 441 | TSGE |
| | 464 to 467 | SQQD |
| N-myristoylation site | 53 to 58 | GGKPCL |
| | 120 to 125 | GNLGCY |
| | 136 to 141 | GTSKTS |
| | 162 to 167 | GMESGY |
| | 214 to 219 | GACGGN |

TABLE XXIV-continued

| Type of Potential Modification Site or Domain | Amino Acid Residues of SEQ ID NO: 373 | Amino Acid Sequence |
|---|---|---|
| Kringle domain signature | 85 to 90 | YCRNPD |
| Kringle Domain | 34 to 116 | |
| CUB domain | 216 to 320 | |

TABLE XXV

| Type of Potential Modification Site or Domain | Amino Acid Residues of SEQ ID NO: 439 | Amino Acid Sequence |
|---|---|---|
| N-glycosylation site | 59 to 62 | NETF |
| | 217 to 220 | NYSA |
| | 255 to 258 | NFTL |
| | 293 to 296 | NVSL |
| | 333 to 336 | NQTL |
| | 345 to 348 | NLSV |
| cAMP- or cGMP-dependent protein kinase phosphorylation site | 455 to 458 | RRSS |
| Protein kinase C phosphorylation site | 68 to 70 | TLK |
| | 135 to 137 | TSK |
| | 139 to 141 | SNK |
| | 153 to 155 | SQR |
| | 236 to 238 | TGR |
| | 243 to 245 | TIR |
| | 275 to 277 | THR |
| | 283 to 285 | SGR |
| | 305 to 307 | SDR |
| | 353 to 355 | SSK |
| | 408 to 410 | SQR |
| | 453 to 455 | SLR |
| | 457 to 459 | SSR |
| Casein kinase II phosphorylation site | 28 to 31 | SGPE |
| | 257 to 260 | TLFD |
| | 321 to 324 | TKEE |
| | 335 to 338 | TLAE |
| | 384 to 387 | TATE |
| N-myristoylation site | 51 TO 56 | GGKPCL |
| | 118 TO 123 | GNLGCY |
| | 134 TO 139 | GTSKTS |
| | 160 TO 165 | GMESGY |
| | 212 TO 217 | GACGGN |
| | 391 TO 396 | GLCTAW |
| | 429 TO 434 | GTVVSL |
| Kringle domain signature | 83 to 88 | YCRNPD |
| Kringle Domain | 32 to 114 | |
| CUB domain | 214 to 318 | |

In various embodiments, the protein of the invention has at least 1, 2, 4, 6, 10, 15, or 20 or more of the post-translational modification sites described herein in Tables XXIV and XXV.

Examples of additional domains present in human and murine TANGO 202 protein include Kringle domains and CUB domains. In one embodiment, the protein of the invention has at least one domain that is at least 55%, preferably at least about 65%, more preferably at least about 75%, yet more preferably at least about 85%, and most preferably at least about 95% identical to one of the domains described herein in Tables XXIV and XXV. Preferably, the protein of the invention has at least one Kringle domain and one CUB domain.

A Kringle domain has a characteristic profile that has been described in the art (Castellino and Beals (1987) J. Mol. Evol. 26:358-369; Patthy (1985) Cell 41:657-663; Ikeo et al. (1991) FEBS Lett. 287:146-148). Many, but not all, Kringle domains comprise a conserved hexapeptide signature sequence, namely (F or Y)—C—R—N—P-(D or N or R) (SEQ ID NO: 455).

The cysteine residue is involved in a disulfide bond.

Kringle domains are triple-looped, disulfide cross-linked domains found in a varying number of copies in, for example, some serine proteases and plasma proteins. Kringle domains have a role in binding mediators (e.g., membranes, other proteins, or phospholipids) and in regulation of proteolytic activity. Kringle domains have been identified in the following proteins, for example: apolipoprotein A, blood coagulation factor XII (Hageman factor), hepatocyte growth factor (HGF), HGF-like protein (Friezner Degen et al., (1991) Biochemistry 30:9781-9791), HGF activator (Miyazawa et al., (1993) J. Biol. Chem. 268:10024-10028), plasminogen, thrombin, tissue plasminogen activator, urokinase-type plasminogen activator, and four influenza neuramimidases. The presence of a Kringle domain in each of human and murine TANGO 202 protein indicates that TANGO 202 is involved in one or more physiological processes in which these other Kringle domain-containing proteins are involved, has biological activity in common with one or more of these other Kringle domain-containing proteins, or both.

CUB domains are extracellular domains of about 110 amino acid residues which occur in functionally diverse, mostly developmentally regulated proteins (Bork and Beckmann (1993) J. Mol. Biol. 231:539-545; Bork (1991) FEBS Lett. 282:9-12). Many CUB domains contain four conserved cysteine residues, although some, like that of TANGO 202, contain only two of the conserved cysteine residues. The structure of the CUB domain has been predicted to assume a beta-barrel configuration, similar to that of immunoglobulins. Other proteins which have been found to comprise one or more CUB domains include, for example, mammalian complement sub-components Cls and Clr, hamster serine protease Casp, mammalian complement activating component of Ra-reactive factor, vertebrate enteropeptidase, vertebrate bone morphogenic protein 1, sea urchin blastula proteins BP10 and SpAN, *Caenorhabditis elegans* hypothetical proteins F42A10.8 and R151.5, neuropilin (A5 antigen), sea urchin fibropellins I and III, mammalian hyaluronate-binding protein TSG-6 (PS4), mammalian spermadhesins, and Xenopus embryonic protein UVS.2. The presence of a CUB domain in each of human and murine TANGO 202 protein indicates that TANGO 202 is involved in one or more physiological processes in which these other CUB domain-containing proteins are involved, has biological activity in common with one or more of these other CUB domain-containing proteins, or both.

The signal peptide prediction program SIGNALP (Nielsen et al. (1997) Protein Engineering 10:1-6) predicted that human TANGO 202 protein includes a 19 amino acid signal peptide (amino acid residues 1 to 19 of SEQ ID NO: 373; SEQ ID NO: 374) preceding the mature TANGO 202 protein (amino acid residues 20 to 475 of SEQ ID NO: 373; SEQ ID NO: 375). Human TANGO 202 protein includes an extracellular domain (amino acid residues 20 to 392 of SEQ ID NO: 373; SEQ ID NO: 376); a transmembrane domain (amino acid residues 393 to 415 of SEQ ID NO: 373; SEQ ID NO: 377); and a cytoplasmic domain (amino acid residues 416 to 475 of SEQ ID NO: 373; SEQ ID NO: 378). The murine homolog of TANGO 202 protein is predicted to be a secreted protein. Thus, it is recognized that human TANGO 202 can also exist in the form of a secreted protein, likely being translated from an alternatively spliced TANGO 202 mRNA. In a variant form of the protein, an extracellular portion of TANGO 202 protein (e.g., amino acid residues 20 to 392 of SEQ ID NO: 373) can be cleaved from the mature protein to generate a soluble fragment of TANGO 202.

FIG. 56A depicts a hydrophobicity plot of human TANGO 202 protein. Relatively hydrophobic regions are above the dashed horizontal line, and relatively hydrophilic regions are below the dashed horizontal line. The hydrophobic region which corresponds to amino acid residues 1 to 19 of SEQ ID NO: 373 is the signal sequence of human TANGO 202 (SEQ ID NO: 374). The hydrophobic region which corresponds to amino acid residues 393 to 415 of SEQ ID NO: 373 is the transmembrane domain of human TANGO 202 (SEQ ID NO: 377). As described elsewhere herein, relatively hydrophilic regions are generally located at or near the surface of a protein, and are more frequently effective immunogenic epitopes than are relatively hydrophobic regions. For example, the region of human TANGO 202 protein from about amino acid residue 61 to about amino acid residue 95 appears to be located at or near the surface of the protein, while the region from about amino acid residue 395 to about amino acid residue 420 appears not to be located at or near the surface.

The predicted molecular weight of human TANGO 202 protein without modification and prior to cleavage of the signal sequence is about 51.9 kilodaltons. The predicted molecular weight of the mature human TANGO 202 protein without modification and after cleavage of the signal sequence is about 50.1 kilodaltons.

The full length of the cDNA encoding murine TANGO 202 protein (SEQ ID NO: 437) is 4928 nucleotide residues. The ORF of this cDNA, nucleotide residues 81 to 1490 of SEQ ID NO: 437 (i.e., SEQ ID NO: 438), encodes a 470-amino acid secreted protein (SEQ ID NO: 439).

The signal peptide prediction program SIGNALP (Nielsen et al. (1997) Protein Engineering 10:1-6) predicted that murine TANGO 202 protein includes a 19 amino acid signal peptide (amino acid residues 1 to 19 of SEQ ID NO: 439; SEQ ID NO: 412) preceding the mature TANGO 202 protein (amino acid residues 20 to 470 of SEQ ID NO: 439; SEQ ID NO: 413). Murine TANGO 202 protein is a secreted protein.

FIG. 56A depicts a hydrophobicity plot of murine TANGO 202 protein. Relatively hydrophobic regions are above the dashed horizontal line, and relatively hydrophilic regions are below the dashed horizontal line. The hydrophobic region which corresponds to amino acid residues 1 to 19 of SEQ ID NO: 439 is the signal sequence of murine TANGO 202 (SEQ ID NO: 412). As described elsewhere herein, relatively hydrophilic regions are generally located at or near the surface of a protein, and are more frequently effective immunogenic epitopes than are relatively hydrophobic regions. For example, the region of murine TANGO 202 protein from about amino acid residue 61 to about amino acid residue 95 appears to be located at or near the surface of the protein, while the region from about amino acid residue 295 to about amino acid residue 305 appears not to be located at or near the surface The predicted molecular weight of murine TANGO 202 protein without modification and prior to cleavage of the signal sequence is about 51.5 kilodaltons. The predicted molecular weight of the mature murine TANGO 202 protein without modification and after cleavage of the signal sequence is about 49.7 kilodaltons.

Human and murine TANGO 202 proteins exhibit considerable sequence similarity, as indicated herein in FIGS. 55A-55B. FIGS. 55A-55B depict an alignment of human and murine TANGO 202 amino acid sequences (SEQ ID NOs: 373 and 439, respectively). In this alignment (made using the ALIGN software {Myers and Miller (1989) CABIOS, ver. 2.0}; pam120.mat scoring matrix; gap penalties −12/−4), the proteins are 76.5% identical. The human and murine ORFs encoding TANGO 202 are 87.4% identical, as assessed using the same software and parameters.

In situ hybridization experiments in mouse tissues indicated that mRNA corresponding to the cDNA encoding TANGO 202 is expressed in the tissues listed in Table XXVI, wherein "+" indicates detectable expression and "++" indicates a greater level of expression than "+".

TABLE XXVI

| Animal | Tissue | Relative Level of Expression |
|---|---|---|
| Mouse (Adult) | bladder, especially in transitional epithelium | ++ |
| | renal glomeruli | + |
| | brain | + |
| | heart | + |
| | liver | + |
| | spleen | + |
| | placenta | + |
| Mouse (Embryo) | ubiquitous | + |

Uses of TANGO 202 Nucleic Acids, Polypeptides, and Modulators Thereof

TANGO 202 proteins are involved in disorders which affect both tissues in which they are normally expressed and tissues in which they are normally not expressed. Based on the observation that TANGO 202 is expressed in human fetal skin, ubiquitously in fetal mouse tissues, in adult murine bone marrow stromal cells, and in cells of adult murine bladder, renal glomeruli, brain, heart, liver, spleen and placenta, TANGO 202 protein is involved in one or more biological processes which occur in these tissues. In particular, TANGO 202 is involved in modulating growth, proliferation, survival, differentiation, and activity of cells of these tissues including, but not limited to, hematopoietic and fetal cells. Thus, TANGO 202 has a role in disorders which affect these cells and their growth, proliferation, survival, differentiation, and activity. Ubiquitous expression of TANGO 202 in fetal murine tissues, contrasted with limited expression in adult murine tissues further indicates that TANGO 202 is involved in disorders in which it is inappropriately expressed (e.g., disorders in which TANGO 202 is expressed in adult murine tissues other than bone marrow stromal cells and disorders in which TANGO 202 is not expressed in one or more developing fetal tissues).

The presence of a Kringle domain in both the murine and human TANGO 202 proteins indicates that this protein is involved in modulating cellular binding to one or more mediators (e.g., proteins, phospholipids, intracellular organelles, or other cells), in modulating proteolytic activity, or both. The presence of a Kringle domain in other proteins (e.g., growth factors) indicates activities that these proteins share with TANGO 202 protein (e.g., modulating cell dissociation and migration into and through extracellular matrices). The presence of Kringle domains in numerous plasma proteins, particularly coupled with the observation that TANGO 202 is expressed in adult murine bone marrow stromal cells, indicates a role for TANGO 202 protein in modulating binding of blood or hematopoietic cells (or both) to one or more mediators. Thus, TANGO 202 is involved in disorders relating to aberrant cellular protease activity, inappropriate interaction or non-interaction of cells with mediators, and in blood and hematopoietic cell-related disorders. Such disorders include, by way of example and not limitation, immune disorders, infectious diseases, auto-immune disorders, vascular and cardiovascular disorders, disorders related to mal-expression of growth factors, cancers, hematological disorders, and the like.

The cDNA encoding TANGO 202 exhibits significant nucleotide sequence similarity with a polynucleotide encoding a kringle-domain-containing protein (designated HTHBZ47) described in the European Patent Application No. EP 0 911 399 A2 (published Apr. 28, 1999). Thus, the TANGO 202 protein can exhibit one or more of the activities exhibited by HTHBZ47, and can be used to prevent, inhibit, diagnose, and treat one or more disorders for which HTHBZ47 is useful. These disorders include cancer, inflammation, autoimmune disorders, allergic disorders, asthma, rheumatoid arthritis, inflammation of central nervous system tissues, cerebellar degeneration, Alzheimer's disease, Parkinson's disease, multiple sclerosis, amylotrophic lateral sclerosis, head injury damage and other neurological abnormalities, septic shock, sepsis, stroke, osteoporosis, osteoarthritis, ischemic reperfusion injury, cardiovascular disease, kidney disease, liver disease, ischemic injury, myocardial infarction, hypotension, hypertension, AIDS, myelodysplastic syndromes and other hematologic abnormalities, aplastic anemia, male pattern baldness, and bacterial, fungal, protozoan, and viral infections.

The presence of a CUB domain in both the murine and human TANGO 202 proteins indicates that this protein is involved in biological processes common to other CUB domain-containing proteins, such as developmental processes and binding to mediators. Therefore, TANGO 202 protein has a role in disorders which involve inappropriate developmental processes (e.g., abnormally high proliferation or un-differentiation of a differentiated tissue or abnormally low differentiation or proliferation of a non-developed or non-differentiated tissue) and modulation of cell growth, proliferation, survival, differentiation, and activity. Such disorders include, by way of example and not limitation, various cancers and birth and developmental defects.

Thus, proteins and nucleic acids of the invention which are identical to, similar to, or derived from human and murine TANGO 202 proteins and nucleic acids encoding them are useful for preventing, diagnosing, and treating, among others, vascular and cardiovascular disorders, hematological disorders, disorders related to mal-expression of growth factors, and cancer. Other uses for these proteins and nucleic acids of the invention relate to modulating cell growth (e.g., angiogenesis), proliferation (e.g., cancers), survival (e.g., apoptosis), differentiation (e.g., hematopoiesis), and activity (e.g., ligand-binding capacity). TANGO 202 proteins and nucleic acids encoding them are also useful for modulating cell dissociation and modulating migration of cells in extracellular matrices.

TANGO 234

A cDNA clone (designated jthsa104d11) encoding at least a portion of human TANGO 234 protein was isolated from a human fetal spleen cDNA library. The human TANGO 234 protein is predicted by structural analysis to be a transmembrane protein, although it can exist in a secreted form as well.

The full length of the cDNA encoding human TANGO 234 protein (SEQ ID NO: 379) is 4628 nucleotide residues. The ORF of this cDNA, nucleotide residues 28 to 4386 of SEQ ID NO: 379 (i.e., SEQ ID NO: 380), encodes a 1453-amino acid transmembrane protein (SEQ ID NO: 381).

The invention thus includes purified human TANGO 234 protein, both in the form of the immature 1453 amino acid residue protein (SEQ ID NO: 381) and in the form of the mature 1413 amino acid residue protein (SEQ ID NO: 383).

Mature human TANGO 234 protein can be synthesized without the signal sequence polypeptide at the amino terminus thereof, or it can be synthesized by generating immature TANGO 234 protein and cleaving the signal sequence therefrom.

The invention includes nucleic acid molecules which encode a polypeptide of the invention. Such nucleic acids include, for example, a DNA molecule having the nucleotide sequence listed in SEQ ID NO: 379 or some portion thereof, such as the portion which encodes mature TANGO 234 protein, immature TANGO 234 protein, or a domain of TANGO 234 protein. These nucleic acids are collectively referred to as nucleic acids of the invention.

TANGO 234 proteins and nucleic acid molecules encoding them comprise a family of molecules having certain conserved structural and functional features, as indicated by the conservation of amino acid sequence between human TANGO 234 protein and bovine WC1 protein, as shown in FIGS. 58A-58F, and the conservation of nucleotide sequence between the ORFs encoding human TANGO 234 protein and bovine WC1 protein, as shown in FIGS. 59A-59Q.

A common domain present in TANGO 234 proteins is a signal sequence. In one embodiment, a TANGO 234 protein contains a signal sequence corresponding to amino acid residues 1 to 40 of SEQ ID NO: 381 (SEQ ID NO: 382). The signal sequence is cleaved during processing of the mature protein.

TANGO 234 proteins can include an extracellular domain. The human TANGO 234 protein extracellular domain is located from about amino acid residue 41 to about amino acid residue 1359 of SEQ ID NO: 381. TANGO 234 can alternately exist in a secreted form, such as a mature protein having the amino acid sequence of amino acid residues 41 to 1453 or residues 41 to about 1359 of SEQ ID NO: 381.

In addition, TANGO 234 include a transmembrane domain. In one embodiment, a TANGO 234 protein of the invention contains a transmembrane domain corresponding to about amino acid residues 1360 to 1383 of SEQ ID NO: 381 (SEQ ID NO: 385).

The present invention includes TANGO 234 proteins having a cytoplasmic domain, particularly including proteins having a carboxyl-terminal cytoplasmic domain. The human TANGO 234 cytoplasmic domain is located from about amino acid residue 1384 to amino acid residue 1453 of SEQ ID NO: 381 (SEQ ID NO: 386).

TANGO 234 proteins typically comprise a variety of potential post-translational modification sites (often within an extracellular domain), such as those described herein in Table XXVII, as predicted by computerized sequence analysis of TANGO 234 proteins using amino acid sequence comparison software (comparing the amino acid sequence of TANGO 234 with the information in the PROSITE database {rel. 12.2; February 1995} and the Hidden Markov Models database {Rel. PFAM 3.3}). In certain embodiments, a protein of the invention has at least 1, 2, 4, 6, 10, 15, or 20 or more of the post-translational modification sites listed in Table XXVII.

TABLE XXVII

| Type of Potential Modification Site or Domain | Amino Acid Residues of SEQ ID NO: 381 | Amino Acid Sequence |
|---|---|---|
| N-glycosylation site | 42 to 45 | NGTD |
| | 78 to 81 | NTTA |
| | 120 to 123 | NESA |

TABLE XXVII-continued

| Type of Potential Modification Site or Domain | Amino Acid Residues of SEQ ID NO: 381 | Amino Acid Sequence |
|---|---|---|
| | 161 to 164 | NNSC |
| | 334 to 337 | NESF |
| | 377 to 380 | NCSG |
| | 441 to 444 | NESA |
| | 548 to 551 | NESN |
| | 637 to 640 | NAST |
| | 972 to 975 | NESL |
| | 1013 to 1016 | NVSD |
| | 1084 to 1087 | NATV |
| | 1104 to 1107 | NCTG |
| | 1161 to 1164 | NGTW |
| | 1171 to 1174 | NITT |
| | 1318 to 1321 | NESF |
| | 1354 to 1357 | NASS |
| Glycosaminoglycan attachment site | 558 to 561 | SGWG |
| | 665 to 668 | SGWG |
| cAMP- or cGMP-dependent protein kinase phosphorylation site | 1229 to 1232 | RRIS |
| | 1399 to 1402 | RRGS |
| Protein kinase C phosphorylation site | 165 to 167 | SGR |
| | 268 to 270 | TNR |
| | 379 to 381 | SGR |
| | 419 to 421 | SRR |
| | 469 to 471 | SDK |
| | 506 to 508 | STR |
| | 589 to 591 | SNR |
| | 593 to 595 | SGR |
| | 661 to 663 | SCR |
| | 696 to 698 | SSR |
| | 746 to 748 | TER |
| | 805 to 807 | SGR |
| | 815 to 817 | TWR |
| | 959 to 961 | SVR |
| | 1256 to 1258 | SGR |
| | 1349 to 1351 | SLK |
| | 1396 to 1398 | STR |
| Casein kinase II phosphorylation site | 44 to 47 | TDLE |
| | 71 to 74 | TVCD |
| | 178 to 181 | TICD |
| | 245 to 248 | SHNE |
| | 253 to 256 | TCYD |
| | 258 to 261 | SDLE |
| | 319 to 322 | SGSD |
| | 332 to 335 | SGNE |
| | 392 to 395 | TICD |
| | 439 to 442 | TGNE |
| | 606 to 609 | TVCD |
| | 622 to 625 | SQLD |
| | 673 to 676 | SHSE |
| | 686 to 689 | SDME |
| | 760 to 763 | TGGE |
| | 765 to 768 | SLWD |
| | 818 to 821 | SVCD |
| | 845 to 848 | SVGD |
| | 857 to 860 | TWAE |
| | 907 to 910 | SQCD |
| | 923 to 926 | SLCD |
| | 927 to 930 | THWD |
| | 974 to 977 | SLLD |
| | 1059 to 1062 | TICD |
| | 1106 to 1109 | TGTE |
| | 1145 to 1148 | SETE |
| | 1233 to 1236 | SPAE |
| | 1241 to 1244 | TCED |
| | 1269 to 1272 | TVCD |
| | 1402 to 1405 | SLEE |
| | 1425 to 1428 | TSDD |
| N-myristoylation site | 67 to 72 | GQWGTV |
| | 90 to 95 | GCPFSF |
| | 101 to 106 | GQAVTR |
| | 119 to 124 | GNESAL |
| | 133 to 138 | GSHNCY |
| | 160 to 165 | GNNSCS |
| | 197 to 202 | GCPSSF |
| | 226 to 231 | GNELAL |
| | 240 to 245 | GNHDCS |

TABLE XXVII-continued

| Type of Potential Modification Site or Domain | Amino Acid Residues of SEQ ID NO: 381 | Amino Acid Sequence |
|---|---|---|
| | 267 to 272 | GTNRCM |
| | 304 to 309 | GCGTAL |
| | 328 to 333 | GVSCSG |
| | 374 to 379 | GSNNCS |
| | 411 to 416 | GCPFSV |
| | 418 to 423 | GSRRAK |
| | 440 to 445 | GNESAL |
| | 465 to 470 | GVICSD |
| | 547 to 552 | GNESNI |
| | 588 to 593 | GSNRCS |
| | 632 to 637 | GMGLGN |
| | 668 to 673 | GNNDCS |
| | 679 to 684 | GVICSD |
| | 695 to 700 | GTWGSV |
| | 712 to 717 | GCGENG |
| | 720 to 725 | GSWGTV |
| | 758 to 763 | GCGSAL |
| | 853 to 858 | GQGTGT |
| | 891 to 896 | GQSDCG |
| | 944 to 949 | GVRCSG |
| | 985 to 990 | GTRTSD |
| | 992 to 997 | GCEDAS |
| | 1078 to 1083 | GVLPAS |
| | 1121 to 1126 | GSSRCA |
| | 1132 to 1137 | GILCAN |
| | 1162 to 1167 | GMNIAE |
| | 1185 to 1190 | GCTGGE |
| | 1265 to 1270 | GNGLTW |
| | 1288 to 1293 | GVVCSR |
| | 1302 to 1307 | GTALST |
| | 1331 to 1336 | GAPPCI |
| | 1342 to 1347 | GNTVSV |
| | 1422 to 1427 | GCGVAF |
| | 1443 to 1438 | GQHDCR |
| | 1444 to 1449 | GVICSE |
| Amidation site | 1167 to 1170 | VGRR |
| Speract receptor repeated (SRR) domain signature | 53 to 90 | |
| | 160 to 197 | |
| | 267 to 304 | |
| | 1041 to 1078 | |
| | 1251 to 1288 | |
| Scavenger receptor cysteine-rich (SRCR) domain | 51 to 148 | |
| | 158 to 255 | |
| | 265 to 362 | |
| | 372 to 469 | |
| | 479 to 576 | |
| | 586 to 683 | |
| | 693 to 790 | |
| | 798 to 895 | |
| | 903 to 1000 | |
| | 1039 to 1136 | |
| | 1146 to 1243 | |
| | 1249 to 1346 | |

Among the domains that occur in TANGO 234 protein are SRR domains and SRCR domains. In one embodiment, the protein of the invention has at least one domain that is at least 55%, preferably at least about 65%, more preferably at least about 75%, yet more preferably at least about 85%, and most preferably at least about 95% identical to one of these domains. In other embodiments, the protein has at least two of the SRR and SRCR domains described herein in Table XXVII. In other embodiments, the protein has at least one SRR domain and at least one SRCR domain.

The SRR domain is named after a receptor domain identified in a sea urchin egg protein designated speract. The consensus sequence of this domain (using standard one-letter amino acid codes, wherein X is any amino acid residue) is as follows. -G-$X_5$-G-$X_2$-E-$X_6$—W-G-$X_2$—C—$X_3$—(F or Y or W)-$X_8$—C—$X_3$-G-(SEQ ID NO: 456).

Speract is a transmembrane glycoprotein of 500 amino acid residues (Dangott et al. (1989) Proc. Natl. Acad. Sci. USA 86:2128-2132). Structurally, this receptor consists of a large extracellular domain of 450 residues, followed by a transmembrane region and a small cytoplasmic domain of 12 amino acid residues. The extracellular domain contains four repeats of an approximately 115 amino acid domain. There are 17 amino acid residues that are perfectly conserved in the four repeats in speract, including six cysteine residues, six glycine residues, and two glutamate residues. TANGO 234 has five SRR domains, in which 16 of the 17 conserved speract residues are present of four of the SRR domains and 15 are present in the remaining SRR domain. This domain is designated the speract receptor repeated domain. The amino acid sequence of mammalian macrophage scavenger receptor type I (MSRI) exhibits such a domain (Freeman et al. (1990) Proc. Natl. Acad. Sci. USA 87:8810-8814). MSRI proteins are membrane glycoproteins implicated in the pathologic deposition of cholesterol in arterial walls during atherogenesis. TANGO 234 is involved in one or more physiological processes related to cholesterol deposition and atherogenesis, as well as other vascular and cardiovascular disorders.

Scavenger receptor cysteine-rich (SRCR) domains are disulfide rich extracellular domains which are present in certain cell surface and secreted proteins. Proteins having SRCR domains exhibit diverse ligand binding specificity. For example, in addition to modified lipoproteins, some of these proteins bind a variety of surface components of pathogenic microorganisms, and some of the proteins bind apoptotic cells. SRCR domains are also involved in mediating immune development and response. Other SRCR-containing proteins are involved in binding of modified lipoproteins (e.g., oxidized low density lipoprotein {LDL}) by specialized macrophages, leading to the formation of macrophages filled with cholesteryl ester droplets (i.e., foam cells). TANGO 234 is involved in one or more physiological processes in which these other SRCR domain-containing proteins are involved, such as LDL uptake and metabolism, regulation of serum cholesterol level, atherogenesis, atherosclerosis, bacterial or viral infections, immune development, and generation and perseverance of immune responses.

WC1 is a ruminant protein having an SRCR domain. WC1 and gamma delta T-cell receptor are the only known gamma delta T-cell specific antigens. Antibodies which bind specifically with WC1 induce growth arrest in IL-2-dependent gamma delta T-cell and augment proliferation of gamma delta T-cells in an autologous mixed lymphocyte reaction or in the presence of anti-CD2 or anti-CD5 antibodies. Injection of antibodies which bind specifically with WC1 into calves results in long-lasting depletion of gamma delta T-cells. Furthermore, antibodies which bind specifically with WC1 can be used to purify gamma delta T-cells.

Gamma delta T-cells are involved in a variety of physiological processes. For example, these cells are potential mediators of allergic airway inflammation and lyme disease. Furthermore, these cells are involved in natural resistance to viral infections and can mediate autoimmune diseases. Elimination of gamma delta T-cells by injection of antibodies which bind specifically therewith can affect the outcomes of these disorders.

TANGO 234 is likely the human orthologue of ruminant protein WC1, and thus is involved with the physiological processes described above in humans. An alignment of the amino acid sequences of (human) TANGO 234 and bovine WC1 protein is shown in FIGS. 58A-58F. In this alignment (made using the ALIGN software {Myers and Miller (1989) CABIOS, ver. 2.0}; pam120.mat scoring matrix; gap penalties −12/−4), the proteins are 40.4% identical. An alignment of the nucleotide sequences of the ORFs encoding (human) TANGO 234 and bovine WC1 protein is shown in FIGS. 59A-59Q. The two ORFs are 54.3% identical, as assessed using the same software and parameters.

The signal peptide prediction program SIGNALP (Nielsen et al. (1997) Protein Engineering 10:1-6) predicted that human TANGO 234 protein includes a 40 amino acid signal peptide (amino acid residues 1 to 40 of SEQ ID NO: 381; SEQ ID NO: 382) preceding the mature TANGO 234 protein (amino acid residues 41 to 4386 of SEQ ID NO: 381; SEQ ID NO: 383). Human TANGO 234 protein includes an extracellular domain (amino acid residues 41 to 1359 of SEQ ID NO: 381; SEQ ID NO: 384); a transmembrane domain (amino acid residues 1360 to 1383 of SEQ ID NO: 381; SEQ ID NO: 385); and a cytoplasmic domain (amino acid residues 1384 to 1453 of SEQ ID NO: 381; SEQ ID NO: 386).

FIG. 57 depicts a hydrophobicity plot of human TANGO 234 protein. Relatively hydrophobic regions are above the dashed horizontal line, and relatively hydrophilic regions are below the dashed horizontal line. The hydrophobic region which corresponds to amino acid residues 1 to 40 of SEQ ID NO: 381 is the signal sequence of human TANGO 234 (SEQ ID NO: 382). The hydrophobic region which corresponds to amino acid residues 1360 to 1383 of SEQ ID NO: 381 is the transmembrane domain of human TANGO 234 (SEQ ID NO: 385). As described elsewhere herein, relatively hydrophilic regions are generally located at or near the surface of a protein, and are more frequently effective immunogenic epitopes than are relatively hydrophobic regions. For example, the region of human TANGO 234 protein from about amino acid residue 225 to about amino acid residue 250 appears to be located at or near the surface of the protein, while the region from about amino acid residue 990 to about amino acid residue 1000 appears not to be located at or near the surface.

The predicted molecular weight of human TANGO 234 protein without modification and prior to cleavage of the signal sequence is about 159.3 kilodaltons. The predicted molecular weight of the mature human TANGO 234 protein without modification and after cleavage of the signal sequence is about 154.7 kilodaltons.

Chromosomal mapping to identify the location of the gene encoding human TANGO 234 protein indicated that the gene was located at chromosomal location h12p13 (with synteny to mo6). Flanking chromosomal markers include WI-6980 and GATA8A09.43. Nearby human loci include IBD2 (inflammatory bowel disease 2), FPF (familial periodic fever), and HPDR2 (hypophosphatemia vitamin D resistant rickets 2). Nearby genes are KLRC (killer cell receptor cluster), DRPLA (dentatorubro-pallidoluysian atrophy), GAPD (glyceraldehyde-3-phosphate) dehydrogenase, and PXR1 (peroxisome receptor 1). Murine chromosomal mapping indicated that the murine orthologue is located near the scr (scruffy) locus. Nearby mouse genes include drpla (dentatorubral phillidoluysian atrophy), prp (proline rich protein), and kap (kidney androgen regulated protein).

Northern analysis experiments indicated that mRNA corresponding to the cDNA encoding TANGO 234 is expressed in the tissues listed in Table XXVIII, wherein "++" indicates moderate expression, "+" indicates lower expression, and "−" indicates no detectable expression.

TABLE XXVIII

| Animal | Tissue | Relative Level of Expression |
|---|---|---|
| Human | spleen | ++ |
| | fetal lung | ++ |
| | lung | + |
| | thymus | + |
| | bone marrow | − |
| | peripheral blood leukocytes | − |

Uses of TANGO 234 Nucleic Acids, Polypeptides, and Modulators Thereof

TANGO 234 proteins are involved in disorders which affect both tissues in which they are normally expressed and tissues in which they are normally not expressed. Based on the observation that TANGO 234 is expressed in human fetal lung, spleen, and, to a lesser extent in adult lung and thymus tissue, TANGO 234 protein is involved in one or more biological processes which occur in these tissues. In particular, TANGO 234 is involved in modulating growth, proliferation, survival, differentiation, and activity of cells including, lung, spleen, thymus, bone marrow, hematopoietic, peripheral blood leukocytes, and fetal cells of the animal in which it is normally expressed. Thus, TANGO 234 has a role in disorders which affect these cells and their growth, proliferation, survival, differentiation, and activity. TANGO 234 can have a role in the lung, spleen, and hematological described elsewhere in this disclosure. Expression of TANGO 234 in an animal is also involved in modulating growth, proliferation, survival, differentiation, and activity of cells and viruses which are foreign to the host (i.e., bacterial, fungal, and viral infections).

Homology of human TANGO 234 with bovine WC1 protein indicates that TANGO 234 has physiological functions in humans analogous to the functions of WC1 in ruminants. Thus, TANGO 234 is involved in modulating growth, proliferation, survival, differentiation, and activity of gamma delta T cells. For example, TANGO 234 affects the ability of gamma delta T cells to interact with chemokines such as interleukin-2. TANGO 234 therefore is involved in the physiological processes associated with allergic airway inflammation, lyme arthritis, resistance to viral infection, auto-immune diseases, and the like.

In addition, presence in TANGO 234 of SRR and SRCR domains indicates that TANGO 234 is involved in physiological functions identical or analogous to the functions performed by other proteins having such domains. For example, like other SRR domain-containing proteins, TANGO 234 modulates cholesterol deposition in arterial walls, and is thus involved in development and persistence of atherogenesis and arteriosclerosis, as well as other vascular and cardiovascular disorders. Like other SRCR domain-containing proteins, TANGO 234 is involved in uptake and metabolism of LDL, regulation of serum cholesterol level, and can modulate these processes as well as the processes of atherogenesis, arteriosclerosis, immune development, and generation and perseverance of immune responses to bacterial, fungal, and viral infections.

TANGO 265

A cDNA clone (designated jthsa079g01) encoding at least a portion of human TANGO 265 protein was isolated from a human fetal spleen cDNA library. The human TANGO 265 protein is predicted by structural analysis to be a transmembrane membrane protein, although it can exist in a secreted form as well.

The full length of the cDNA encoding human TANGO 265 protein (SEQ ID NO: 387) is 3104 nucleotide residues. The ORF of this cDNA, nucleotide residues 32 to 2314 of SEQ ID NO: 387 (i.e., SEQ ID NO: 388), encodes a 761-amino acid transmembrane protein (SEQ ID NO: 389).

The invention thus includes purified TANGO 265 protein, both in the form of the immature 761 amino acid residue protein (SEQ ID NO: 389) and in the form of the mature 730 amino acid residue protein (SEQ ID NO: 391). Mature TANGO 265 protein can be synthesized without the signal sequence polypeptide at the amino terminus thereof, or it can be synthesized by generating immature TANGO 265 protein and cleaving the signal sequence therefrom.

The invention includes nucleic acid molecules which encode a polypeptide of the invention. Such nucleic acids include, for example, a DNA molecule having the nucleotide sequence listed in SEQ ID NO: 387 or some portion thereof, such as the portion which encodes mature TANGO 265 protein, immature TANGO 265 protein, or a domain of TANGO 265 protein. These nucleic acids are collectively referred to as nucleic acids of the invention.

TANGO 265 proteins and nucleic acid molecules encoding them comprise a family of molecules having certain conserved structural and functional features.

A common domain present in TANGO 265 proteins is a signal sequence. In one embodiment, a TANGO 265 protein contains a signal sequence corresponding to amino acid residues 1 to 31 of SEQ ID NO: 389 (SEQ ID NO: 390). The signal sequence is cleaved during processing of the mature protein.

TANGO 265 proteins can also include an extracellular domain. The human TANGO 265 protein extracellular domain is located from about amino acid residue 32 to about amino acid residue 683 of SEQ ID NO: 389. TANGO 265 can alternately exist in a secreted form, such as a mature protein having the amino acid sequence of amino acid residues 32 to 761 or residues 32 to about 683 of SEQ ID NO: 389.

TANGO 265 proteins can also include a transmembrane domain. In one embodiment, a TANGO 265 protein of the invention contains a transmembrane domain corresponding to about amino acid residues 684 to 704 of SEQ ID NO: 389 (SEQ ID NO: 393).

In addition, TANGO 265 proteins include a cytoplasmic domain, particularly including proteins having a carboxyl-terminal cytoplasmic domain. The human TANGO 265 cytoplasmic domain is located from about amino acid residue 705 to amino acid residue 761 of SEQ ID NO: 389 (SEQ ID NO: 394).

TANGO 265 proteins typically comprise a variety of potential post-translational modification sites (often within an extracellular domain), such as those described herein in Table XXIX, as predicted by computerized sequence analysis of TANGO 265 proteins using amino acid sequence comparison software (comparing the amino acid sequence of TANGO 265 with the information in the PROSITE database {rel. 12.2; February 1995} and the Hidden Markov Models database {Rel. PFAM 3.3}). In certain embodiments, a protein of the invention has at least 1, 2, 4, 6, 10, 15, or 20 or more of the post-translational modification sites listed in Table XXIX.

TABLE XXIX

| Type of Potential Modification Site or Domain | Amino Acid Residues of SEQ ID NO: 389 | Amino Acid Sequence |
| --- | --- | --- |
| N-glycosylation site | 120 to 123 | NETQ |
| | 135 to 138 | NVTH |

TABLE XXIX-continued

| Type of Potential Modification Site or Domain | Amino Acid Residues of SEQ ID NO: 389 | Amino Acid Sequence |
| --- | --- | --- |
| | 496 to 499 | NCSV |
| | 607 to 610 | NGLS |
| Glycosaminoglycan attachment site | 70 to 73 | SGDG |
| cAMP- or cGMP-dependent protein kinase phosphorylation site | 108 to 111 | RKKS |
| | 116 to 119 | KKKS |
| | 281 to 284 | KKWT |
| Protein kinase C phosphorylation site | 106 to 108 | SDR |
| | 262 to 264 | TSR |
| | 361 to 363 | TSR |
| | 366 to 368 | TYR |
| | 385 to 387 | SDK |
| | 533 to 535 | SWK |
| | 555 to 557 | SLR |
| | 721 to 723 | TLR |
| | 738 to 740 | SPK |
| Casein kinase II phosphorylation site | 152 to 155 | TFIE |
| | 176 to 179 | SPFD |
| | 250 to 253 | TASE |
| | 342 to 345 | SLLD |
| | 411 to 414 | SGVE |
| | 498 to 501 | SVYE |
| | 502 to 505 | SCVD |
| | 574 to 577 | SILE |
| | 738 to 741 | SPKE |
| | 745 to 748 | SASD |
| N-myristoylation site | 79 to 84 | GAREAI |
| | 191 to 196 | GMLYSG |
| | 331 to 336 | GGTRSS |
| | 412 to 417 | GVEYTR |
| | 437 to 442 | GTTTGS |
| | 620 to 625 | GLYQCW |
| | 671 to 676 | GAALAA |
| Sema domain | 64 to 478 | |

An example of a domain which occurs in TANGO 265 proteins is a sema domain. In one embodiment, the protein of the invention has at least one domain that is at least 55%, preferably at least about 65%, more preferably at least about 75%, yet more preferably at least about 85%, and most preferably at least about 95% identical to one of the sema domains described herein in Table XXIX.

Sema domains occur in semaphorin proteins. Semaphorins are a large family of secreted and transmembrane proteins, some of which function as repellent signals during neural axon guidance. The sema domain and a variety of semaphorin proteins in which it occurs are described, for example, in Winberg et al. (1998 Cell 95:903-916). Sema domains also occur in human hepatocyte growth factor receptor (Swissprot Accession no. P08581) and the similar neuronal and epithelial transmembrane receptor protein (Swissprot Accession no. P51805). The presence of an sema domain in human TANGO 265 protein indicates that TANGO 265 is involved in one or more physiological processes in which the semaphorins are involved, has biological activity in common with one or more of the semaphorins, or both.

Human TANGO 265 protein exhibits considerable sequence similarity to murine semaphorin B protein (GenBank Accession no. X85991), as indicated herein in FIGS. 60A-60C. FIGS. 60A-60C depict an alignment of the amino acid sequences of human TANGO 265 protein (SEQ ID NO: 389) and murine semaphorin B protein (SEQ ID NO: 446). In this alignment (pam120.mat scoring matrix, gap penalties −12/−4), the amino acid sequences of the proteins are 82.3% identical. FIGS. 61A-61L depict an alignment of the nucleotide sequences of cDNA encoding human TANGO 265 protein (SEQ ID NO: 387) and murine cDNA encoding semaphorin B protein (SEQ ID NO: 447). In this alignment (pam120.mat scoring matrix, gap penalties −12/−4), the nucleic acid sequences of the cDNAs are 76.2% identical. Thus, TANGO 265 is the human orthologue of murine semaphorin B and shares functional similarities to that protein.

It is known that semaphorins are bi-functional, capable of functioning either as attractive axonal guidance proteins or as repellent axonal guidance proteins (Wong et al. (1997) Development 124:3597-3607). Furthermore, semaphorins bind with neuronal cell surface proteins designated plexins, which are expressed on both neuronal cells and cells of the immune system (Comeau et al. (1998) Immunity 8:473-482; Jin and Strittmatter (1997) J. Neurosci. 17:6256-6263).

The signal peptide prediction program SIGNALP (Nielsen et al. (1997) Protein Engineering 10:1-6) predicted that human TANGO 265 protein includes a 31 amino acid signal peptide (amino acid residues 1 to 31 of SEQ ID NO: 389; SEQ ID NO: 390) preceding the mature TANGO 265 protein (amino acid residues 32 to 761 of SEQ ID NO: 389; SEQ ID NO: 391). Human TANGO 265 protein includes an extracellular domain (amino acid residues 32 to 683 of SEQ ID NO:389; SEQ ID NO: 392); a transmembrane domain (amino acid residues 684 to 704 of SEQ ID NO: 389; SEQ ID NO: 393); and a cytoplasmic domain (amino acid residues 705 to 761 of SEQ ID NO: 389; SEQ ID NO: 394).

FIG. 62 depicts a hydrophobicity plot of human TANGO 265 protein. Relatively hydrophobic regions are above the dashed horizontal line, and relatively hydrophilic regions are below the dashed horizontal line. The hydrophobic region which corresponds to amino acid residues 1 to 31 of SEQ ID NO: 389 is the signal sequence of human TANGO 265 (SEQ ID NO: 390). The hydrophobic region which corresponds to amino acid residues 684 to 704 of SEQ ID NO: 389 is the transmembrane domain of human TANGO 265 (SEQ ID NO: 393). As described elsewhere herein, relatively hydrophilic regions are generally located at or near the surface of a protein, and are more frequently effective immunogenic epitopes than are relatively hydrophobic regions. For example, the region of human TANGO 265 protein from about amino acid residue 350 to about amino acid residue 375 appears to be located at or near the surface of the protein, while the region from about amino acid residue 230 to about amino acid residue 250 appears not to be located at or near the surface.

The predicted molecular weight of human TANGO 265 protein without modification and prior to cleavage of the signal sequence is about 83.6 kilodaltons. The predicted molecular weight of the mature human TANGO 265 protein without modification and after cleavage of the signal sequence is about 80.2 kilodaltons.

Chromosomal mapping was performed by computerized comparison of TANGO 265 cDNA sequences against a chromosomal mapping database in order to identify the approximate location of the gene encoding human TANGO 265 protein. This analysis indicated that the gene was located on chromosome 1 between markers D1S305 and D1S2635.

Uses of TANGO 265 Nucleic Acids,
Polypeptides, and Modulators Thereof

TANGO 265 proteins are involved in disorders which affect both tissues in which they are normally expressed and tissues in which they are normally not expressed. Based on the observation that TANGO 265 is expressed in human fetal spleen, involvement of TANGO 265 protein in immune system development and modulation is indicated.

The presence of the sema domain in TANGO 265 indicates that this protein is involved in development of neuronal and epithelial tissues and also functions as a repellant protein which guides axonal development. TANGO 265 modulates nerve growth and regeneration and also modulates growth and regeneration of other epithelial tissues.

TANGO 265 nucleic acids, proteins, and modulators thereof can be used to modulate proliferation, migration, morphology, differentiation, function, or some combination of these, of cells that form the spleen, (e.g., cells of the splenic connective tissue, splenic smooth muscle cells, or endothelial cells of the splenic blood vessels) or of blood cells that are processed (e.g., regenerated, matured, or phagocytized) within the spleen, as described elsewhere in this disclosure.

The observation that TANGO 265 shares significant identity with murine semaphorin B suggests that it has activity identical or analogous to the activity of this protein. These observations indicate that TANGO 265 modulates growth, proliferation, survival, differentiation, and activity of neuronal cells and immune system cells. Thus, TANGO 265 protein is useful, for example, for guiding neural axon development, for modulating differentiation of cells of the immune system, for modulating cytokine production by cells of the immune system, for modulating reactivity of cells of the immune system toward cytokines, for modulating initiation and persistence of an inflammatory response, and for modulating proliferation of epithelial cells.

TANGO 286

A cDNA clone (designated jthkf042e03) encoding at least a portion of human TANGO 286 protein was isolated from a human keratinocyte cDNA library. The human TANGO 286 protein is predicted by structural analysis to be a secreted protein.

The full length of the cDNA encoding TANGO 286 protein (SEQ ID NO: 403) is 1980 nucleotide residues. The ORF of this cDNA, nucleotide residues 133 to 1497 of SEQ ID NO: 403 (i.e., SEQ ID NO: 404), encodes a 455-amino acid secreted protein (SEQ ID NO: 405).

The invention thus includes purified TANGO 286 protein, both in the form of the immature 455 amino acid residue protein (SEQ ID NO: 405) and in the form of the mature 432 amino acid residue protein (SEQ ID NO: 407). Mature TANGO 286 protein can be synthesized without the signal sequence polypeptide at the amino terminus thereof, or it can be synthesized by generating immature TANGO 286 protein and cleaving the signal sequence therefrom.

The invention includes nucleic acid molecules which encode a polypeptide of the invention. Such nucleic acids include, for example, a DNA molecule having the nucleotide sequence listed in SEQ ID NO: 403 or some portion thereof, such as the portion which encodes mature TANGO 286 protein, immature TANGO 286 protein, or a domain of TANGO 286 protein. These nucleic acids are collectively referred to as nucleic acids of the invention.

TANGO 286 proteins and nucleic acid molecules encoding them comprise a family of molecules having certain conserved structural and functional features.

A common domain of TANGO 286 proteins is a signal sequence. In one embodiment, a TANGO 286 protein contains a signal sequence corresponding to amino acid residues 1 to 23 of SEQ ID NO: 405 (SEQ ID NO: 406). The signal sequence is cleaved during processing of the mature protein.

TANGO 286 is a secreted soluble protein (i.e., a secreted protein having a single extracellular domain), as indicated by computerized sequence analysis and comparison of the amino acid sequence of TANGO 286 with related proteins, such as the soluble proteins designated bactericidal permeability increasing (BPI) protein and recombinant endotoxin neutralizing polypeptide (RENP).

TANGO 286 proteins typically comprise a variety of potential post-translational modification sites (often within an extracellular domain), such as those described herein in Table XXX, as predicted by computerized sequence analysis of TANGO 286 proteins using amino acid sequence comparison software (comparing the amino acid sequence of TANGO 286 with the information in the PROSITE database {rel. 12.2; February 1995} and the Hidden Markov Models database {Rel. PFAM 3.3}). In certain embodiments, a protein of the invention has at least 1, 2, 4, 6, 10, 15, or 20 or more of the post-translational modification sites listed in Table XXX.

TABLE XXX

| Type of Potential Modification Site or Domain | Amino Acid Residues of SEQ ID NO: 405 | Amino Acid Sequence |
|---|---|---|
| N-glycosylation site | 79 to 82 | NFSN |
|  | 92 to 95 | NTSL |
|  | 113 to 116 | NIST |
|  | 161 to 164 | NLST |
|  | 173 to 176 | NYTL |
|  | 205 to 208 | NLTD |
|  | 249 to 252 | NLTL |
|  | 303 to 306 | NFTL |
|  | 320 to 323 | NSTV |
|  | 363 to 366 | NRSN |
| Protein kinase C phosphorylation site | 35 to 37 | TQR |
|  | 362 to 364 | SNR |
|  | 429 to 431 | SSK |
| Casein kinase II phosphorylation site | 63 to 66 | SGSE |
|  | 130 to 133 | SFAE |
|  | 163 to 166 | STLE |
|  | 169 to 172 | TKID |
|  | 175 to 178 | TLLD |
|  | 183 to 186 | SSPE |
|  | 253 to 256 | STEE |
|  | 321 to 324 | STVE |
|  | 365 to 368 | SNIE |
|  | 409 to 412 | SDIE |
| N-myristoylation site | 42 to 47 | GVQAGM |
|  | 269 to 274 | GNVLSR |
| Lipid-binding serum glycoprotein domain | 12 to 427 |  |

Certain lipid-binding serum glycoproteins, such as LPS-binding protein (LBP), bactericidal permeability-increasing protein (BPI), cholesteryl ester transfer protein (CETP), and phospholipid transfer protein (PLTP), share regions of sequence similarity which are herein designated a lipid-binding serum glycoprotein domain (Schumann et al., (1990) Science 249:1429-1431; Gray et al., (1989) J. Biol. Chem. 264:9505-9509; Day et al., (1994) J. Biol. Chem. 269:9388-9391). The consensus pattern of lipid-binding serum glycoprotein domains is as follows (using standard single letter amino acid abbreviations wherein X is any amino acid residue).

-(P or A)-(G or A)-(L or I or V or M or C)—$X_2$—R—(I or V)—(S or T)—$X_3$-L-X($_4$ or 5)-(E or Q)-X4-(L or I or V or M)-X(O or I)-(E or Q or K)-$X_8$—P—(SEQ ID NO: 457; e.g., amino acid residues 28-60 of SEQ ID NO: 405).

Proteins in which a lipid-binding serum glycoprotein domain occurs are often structurally related and exhibit related physiological activities. LBP binds to lipid A moieties of bacterial LPS and, once bound thereto, induces secretion of α-tumor necrosis factor, apparently by interacting with the CD14 receptor. BPI also binds LPS and exerts a cytotoxic effect on Gram-negative bacteria (Elsbach, (1998) J. Leukoc. Biol. 64:14-18). CETP is involved in transfer of insoluble cholesteryl esters during reverse cholesterol transport. PLTP appears to be involved in phospholipid transport and modulation of serum HDL particles.

The signal peptide prediction program SIGNALP (Nielsen et al. (1997) Protein Engineering 10:1-6) predicted that TANGO 286 protein includes a 23 amino acid signal peptide (amino acid residues 1 to 23 of SEQ ID NO: 405; SEQ ID NO: 406) preceding the mature TANGO 286 protein (amino acid residues 24 to 455 of SEQ ID NO: 45; SEQ ID NO: 407). Human TANGO 286 protein is a secreted soluble protein.

FIG. 63 depicts a hydrophobicity plot of TANGO 286 protein. Relatively hydrophobic regions are above the dashed horizontal line, and relatively hydrophilic regions are below the dashed horizontal line. As described elsewhere herein, relatively hydrophilic regions are generally located at or near the surface of a protein, and are more frequently effective immunogenic epitopes than are relatively hydrophobic regions. For example, the region of human TANGO 286 protein from about amino acid residue 420 to about amino acid residue 435 appears to be located at or near the surface of the protein, while the region from about amino acid residue 325 to about amino acid residue 345 appears not to be located at or near the surface.

The predicted molecular weight of TANGO 286 protein without modification and prior to cleavage of the signal sequence is about 50.9 kilodaltons. The predicted molecular weight of the mature TANGO 286 protein without modification and after cleavage of the signal sequence is about 48.2 kilodaltons.

The gene encoding human TANGO 286 protein was determined to be located on chromosome 22 by comparison of matching genomic clones such as the clones assigned GenBank Accession numbers W16806 and AL021937.

A portion of TANGO 286 protein exhibits significant amino acid homology with a region of the human chromosome region 22q12-13 genomic nucleotide sequence having GenBank Accession number AL021937. Alignment of a 45 kilobase nucleotide sequence encoding TANGO 286 with AL021937, however, indicated the presence in TANGO 286 of exons which differ from those disclosed in L021937 (pam1120.mat scoring matrix; gap penalties −12/−4). This region of chromosome 22 comprises an immunoglobulin lambda chain C (IGLC) pseudogene, the Ret finger protein-like 3 (RFPL3) and Ret finger protein-like 3 antisense (RFPL3S) genes, a gene encoding a novel immunoglobulin lambda chain V family protein, a novel gene encoding a protein similar both to mouse RGDS protein (RALGDS, RALGEF, guanine nucleotide dissociation stimulator A) and to rabbit oncogene RSC, a novel gene encoding the human orthologue of worm F16A 11.2 protein, a novel gene encoding a protein similar both to BPI and to rabbit liposaccharide-binding protein, and a 5'-portion of a novel gene. This region also comprises various ESTs, STSs, GSSs, genomic marker D22S1175, a ca repeat polymorphism and putative CpG islands. TANGO 286 protein thus shares one or more structural or functional features of these molecules.

TANGO 286 protein exhibits considerable sequence similarity with BPI protein, having 23.9% amino acid sequence identity therewith, as assessed using the ALIGN v. 2.0 computer software using a pam120.mat scoring matrix and gap penalties of −12/−4. TANGO 286 protein also exhibits considerable sequence similarity with recombinant endotoxin neutralizing polypeptide (RENP), having 24.5% amino acid sequence identity therewith, as assessed using the ALIGN software. Physiological activities of BPI protein and RENP have been described (e.g., Gabay et al., (1989) Proc. Natl. Acad. Sci. USA 86:5610-5614; Elsbach, (1998) J. Leukoc. Biol. 64:14-18; Mahadeva et al., (1997) Chest 112:1699-1701; International patent application WO96/34873). RENP, for example, binds LPS and neutralizes bacterial endotoxins. BPI, RENP, and other proteins in which a lipid-binding serum glycoprotein domain occurs bind LPS and neutralize bacterial endotoxins, and are therefore useful for preventing, detecting, and treating LPS-related disorders such as shock, disseminated intravascular coagulation, anemia, thrombocytopenia, adult respiratory distress syndrome, renal failure, liver disease, and disorders associated with Gram negative bacterial infections. In addition to the physiological conditions described above, BPI protein is known to be involved in vasculitis and bronchiectasis, in that antibodies which bind specifically with BPI protein are present in at least some patients afflicted with these disorders (Mahadeva et al., supra).

Uses of TANGO 286 Nucleic Acids,
Polypeptides, and Modulators Thereof

Expression of TANGO 286 in keratinocyte library indicates that this protein is involved in a disorders which involve keratinocytes. Such disorders include, for example, disorders involving extracellular matrix abnormalities, dermatological disorders, ocular disorders, inappropriate hair growth (e.g., baldness), infections of the nails of the fingers and toes, scalp disorders (e.g., dandruff), and the like.

The fact that TANGO 286 protein contains a lipid-binding serum glycoprotein domain indicates that TANGO 286 is involved in one or more physiological processes in which these other lipid-binding serum glycoprotein domain-containing proteins are involved. Thus, TANGO 286 is involved in one or more of lipid transport, metabolism, serum lipid particle regulation, host anti-microbial defensive mechanisms, and the like.

Human TANGO 286 shares physiological functionality with other proteins in which a lipid-binding serum glycoprotein domains occurs (e.g., LBP, BPI protein, CETP, and PLTP).

Based on the amino acid sequence similarity of TANGO 286 with BPI protein and with RENP, TANGO 286 protein exhibits physiological activities exhibited by these proteins. Thus, TANGO 286 proteins are useful for preventing, diagnosing, and treating, among others, lipid transport disorders, lipid metabolism disorders, disorders of serum lipid particle regulation, obesity, disorders involving insufficient or inappropriate host anti-microbial defensive mechanisms, vasculitis, bronchiectasis, LPS-related disorders such as shock, disseminated intravascular coagulation, anemia, thrombocytopenia, adult respiratory distress syndrome, renal failure, liver disease, and disorders associated with Gram negative bacterial infections, such as bacteremia, endotoxemia, sepsis, and the like.

TANGO 294

A cDNA clone (designated jthrc145g07) encoding at least a portion of human TANGO 294 protein was isolated from a human pulmonary artery smooth muscle cell cDNA library. The human TANGO 294 protein is predicted by structural analysis to be a transmembrane membrane protein. No expression of DNA encoding TANGO 294 was detected in human heart, brain, placenta, lung, liver, skeletal muscle, kidney, or pancreas tissues.

The full length of the cDNA encoding TANGO 294 protein (SEQ ID NO: 415) is 2044 nucleotide residues. The ORF of this cDNA, nucleotide residues 126 to 1394 of SEQ ID NO: 415 (i.e., SEQ ID NO: 416), encodes a 423-amino acid transmembrane protein (SEQ ID NO: 417).

The invention includes purified TANGO 294 protein, both in the form of the immature 423 amino acid residue protein (SEQ ID NO: 417) and in the form of the mature 390 amino acid residue protein (SEQ ID NO: 419). Mature TANGO 294 protein can be synthesized without the signal sequence polypeptide at the amino terminus thereof, or it can be synthesized by generating immature TANGO 294 protein and cleaving the signal sequence therefrom.

The invention includes nucleic acid molecules which encode a polypeptide of the invention. Such nucleic acids include, for example, a DNA molecule having the nucleotide sequence listed in SEQ ID NO: 415 or some portion thereof, such as the portion which encodes mature TANGO 294 protein, immature TANGO 294 protein, or a domain of TANGO 294 protein. These nucleic acids are collectively referred to as nucleic acids of the invention.

TANGO 294 proteins and nucleic acid molecules encoding them comprise a family of molecules having certain conserved structural and functional features.

Also included within the scope of the invention are TANGO 294 proteins having a signal sequence. In one embodiment, a TANGO 294 protein contains a signal sequence corresponding to amino acid residues 1 to 33 of SEQ ID NO: 417 (SEQ ID NO: 418). The signal sequence is cleaved during processing of the mature protein.

The naturally-occurring form of TANGO 294 protein is a secreted protein (i.e., not comprising the predicted signal sequence). However, in variant forms, TANGO 294 proteins can be transmembrane proteins which include an extracellular domain. In this transmembrane variant form, the predicted TANGO 294 protein extracellular domain is located from about amino acid residue 34 to about amino acid residue 254 of SEQ ID NO: 417, the predicted cytoplasmic domain is located from about amino acid residue 280 to amino acid residue 423 of SEQ ID NO: 417 (SEQ ID NO: 422), and the predicted transmembrane domain is located from about amino acid residues 255 to 279 of SEQ ID NO: 417 (SEQ ID NO: 421).

TANGO 294 proteins typically comprise a variety of potential post-translational modification sites (often within an extracellular domain), such as those described herein in Table XXXI, as predicted by computerized sequence analysis of TANGO 294 proteins using amino acid sequence comparison software (comparing the amino acid sequence of TANGO 294 with the information in the PROSITE database {rel. 12.2; February 1995} and the Hidden Markov Models database {Rel. PFAM 3.3}). In certain embodiments, a protein of the invention has at least 1, 2, 4, 6, 10, 15, or 20 or more of the post-translational modification sites listed in Table XXXI.

TABLE XXXI

| Type of Potential Modification Site or Domain | Amino Acid Residues of SEQ ID NO: 417 | Amino Acid Sequence |
|---|---|---|
| N-glycosylation site | 48 to 51 | NISE |
| | 113 to 116 | NNSL |
| | 285 to 288 | NMSR |
| | 413 to 416 | NLSQ |
| Protein kinase C phosphorylation site | 12 to 14 | SHR |
| | 138 to 140 | SRK |
| | 217 to 219 | TVK |
| Casein kinase II phosphorylation site | 155 to 158 | SYDE |
| | 175 to 178 | TGQE |
| | 198 to 201 | TMPE |
| | 360 to 363 | SNPE |
| Tyrosine kinase phosphorylation site | 174 to 182 | KTGQEKIYY |
| N-myristoylation site | 99 to 104 | GLVGGA |
| | 130 to 135 | GNSRGN |
| | 188 to 193 | GTTMGF |
| | 277 to 282 | GGFNTN |
| Amidation site | 240 to 243 | FGKK |
| Lipase serine active site | 180 to 189 | IYYVGYSQGT |
| Alpha/beta hydrolase fold domain | 125 to 404 | |

Alpha/beta hydrolase fold domains occur in a wide variety of enzymes (Ollis et al., (1992) Protein Eng. 5:197-211). The alpha/beta fold domain is a conserved topological domain in which sequence homology is not necessarily conserved. Conservation of topology in the alpha/beta fold domain preserves arrangement of catalytic residues, even though those residues, and the reactions they catalyze, can vary. In many enzymes, particularly including alpha/beta hydrolases, this domain encompasses the active site of the enzyme. In one embodiment, the protein of the invention has at least one domain that is at least 55%, preferably at least about 65%, more preferably at least about 75%, yet more preferably at least about 85%, and most preferably at least about 95% identical to the alpha/beta hydrolase fold domain described herein in Table XXXI.

The signal peptide prediction program SIGNALP (Nielsen et al. (1997) Protein Engineering 10:1-6) predicted that human TANGO 294 protein includes a 33 amino acid signal peptide (amino acid residues 1 to 33 of SEQ ID NO: 417; SEQ ID NO: 418) preceding the mature TANGO 294 protein (amino acid residues 34 to 423 of SEQ ID NO: 417; SEQ ID NO: 419). Human TANGO 294 protein is a soluble secreted protein. However, in the transmembrane variant form, human TANGO 294 protein includes an extracellular domain (amino acid residues 34 to 254 of SEQ ID NO: 417; SEQ ID NO: 420); a transmembrane domain (amino acid residues 255 to 279 of SEQ ID NO: 417; SEQ ID NO: 421); and a cytoplasmic domain (amino acid residues 280 to 423 of SEQ ID NO: 417; SEQ ID NO: 422).

FIG. 67 depicts a hydrophobicity plot of human TANGO 294 protein. Relatively hydrophobic regions are above the dashed horizontal line, and relatively hydrophilic regions are below the dashed horizontal line. The hydrophobic region which corresponds to amino acid residues 1 to 33 of SEQ ID NO: 417 is the signal sequence of human TANGO 294 (SEQ ID NO: 419). The hydrophobic region which corresponds to amino acid residues 255 to 279 of SEQ ID NO: 417 is the predicted transmembrane domain of human TANGO 294 (SEQ ID NO: 421). As described elsewhere herein, relatively hydrophilic regions are generally located at or near the surface of a protein, and are more frequently effective immunogenic epitopes than are relatively hydrophobic regions. For example, the region of human TANGO 294 protein from about amino acid residue 130 to about amino acid residue 150 appears to be located at or near the surface of the protein, while the region from about amino acid residue 90 to about amino acid residue 100 appears not to be located at or near the surface.

The predicted molecular weight of human TANGO 294 protein without modification and prior to cleavage of the signal sequence is about 48.2 kilodaltons. The predicted molecular weight of the mature human TANGO 294 protein without modification and after cleavage of the signal sequence is about 44.2 kilodaltons.

It may be that amino acid residues 1 to 15 of SEQ ID NO: 417 do not occur in TANGO 294 protein. However, it is recognized that amino acid residues 16 to 33 of SEQ ID NO: 417 form a functional signal sequence even in the absence of residues 1 to 15. The amino acid sequence (and hence the properties) of mature TANGO 294 protein are unaffected by presence or absence of amino acid residues 1 to 15 of immature TANGO 294 protein.

Human TANGO 294 protein exhibits considerable sequence similarity (i.e., about 75% amino acid sequence identity) to lingual and gastric lipase proteins of rat (Swissprot Accession no. $P_{04634}$; Docherty et al. (1985) Nucleic Acids Res. 13:1891-1903), dog (Swissprot Accession no. P80035; Carriere et al. (1991) Eur. J. Biochem. 202:75-83), and human (Swissprot Accession no. P07098; Bernbaeck and Blaeckberg (1987) Biochim. Biophys. Acta 909:237-244), as assessed using the ALIGN v. 2.0 computer software using a pam12.mat scoring matrix and gap penalties of −12/−4. TANGO 294 is distinct from the known human lipase, as indicated in FIGS. 66A-66B. FIGS. 66A-66B depict an alignment of the amino acid sequences of human TANGO 294 protein (SEQ ID NO: 417) and the known human lipase protein (SEQ ID NO: 445), as assessed using the same software and parameters. In this alignment (pam120.mat scoring matrix, gap penalties −12/−4), the amino acid sequences of the proteins are 49.8% identical. TANGO 294 also is distinct from the known human lysosomal acid lipase, as indicated in FIGS. 68A-68B. FIGS. 68A-68B depicts an alignment of the amino acid sequences of human TANGO 294 protein (SEQ ID NO: 417) and the known human lysosomal acid lipase protein (SEQ ID NO: 411). In this alignment (pam120.mat scoring matrix, gap penalties −12/−4), the amino acid sequences of the proteins are 56.9% identical.

TANGO 294 is a human lipase distinct from the known human lipase and the known human lysosomal acid lipase. Furthermore, in view of the comparisons of the amino acid sequences of TANGO 294 and the two human lipases and the nature of transcriptional initiation sites, it is recognized that the transcriptional start site can correspond to either of the methionine residues located at residues 1 and 15 of SEQ ID NO: 417 The present invention thus includes proteins in which the initially transcribed amino acid residue is the methionine residue at position 1 of SEQ ID NO: 417 and proteins in which the initially transcribed amino acid residue is the methionine residue at position 15 of SEQ ID NO: 417 (i.e., proteins in which the amino acid sequence of TANGO 294 does not include residues 1 to 14 of SEQ ID NO: 417). Furthermore, because amino acid residues 1 to 14 of SEQ ID NO: 417 are predicted to be part of a signal sequence, it is recognized that the protein not comprising this portion of the amino acid sequence will nonetheless exhibit a functional signal sequence at its amino terminus.

Uses of TANGO 294 Nucleic Acids,
Polypeptides, and Modulators Thereof

The sequence similarity of TANGO 294 and mammalian lingual, gastric, and lysosomal acid lipase proteins indicates that TANGO 294 is involved in physiological processes identical or analogous to those involving these lipases. Thus, TANGO 294 is involved in facilitating absorption and metabolism of fat. TANGO 294 can thus be used, for example, to prevent, detect, and treat disorders relating to fat absorption and metabolism, such as inadequate expression of gastric/pancreatic lipase, cystic fibrosis, exocrine pancreatic insufficiency, obesity, medical treatments which alter fat absorption, and the like.

TANGO 294 protein is known to be expressed in human pulmonary artery smooth muscle tissue. This indicates that TANGO 294 protein is involved in transportation and metabolism of fats and lipids in the human vascular and cardiovascular systems. Thus, TANGO 294 proteins of the invention can be used to prevent, detect, and treat disorders involving these body systems.

INTERCEPT 296

A cDNA clone (designated jthEa030h09) encoding at least a portion of human INTERCEPT 296 protein was isolated from a human esophagus cDNA library. The human INTERCEPT 296 protein is predicted by structural analysis to be a transmembrane protein having three or more transmembrane domains. Expression of DNA encoding INTERCEPT 296 tissue has been detected by northern analysis of human lung tissue. In human lung tissue, two moieties corresponding to INTERCEPT 296 have been identified in Northern blots. It is recognized that these two moieties may represent alternatively polyadenylated INTERCEPT 296 mRNAs or alternatively spliced INTERCEPT 296 mRNAs. It has furthermore been observed that INTERCEPT 296 does not appear to be expressed in any of heart, brain, placenta, skeletal muscle, kidney, and pancreas tissues.

The full length of the cDNA encoding INTERCEPT 296 protein (SEQ ID NO: 423) is 2133 nucleotide residues. The ORF of this cDNA, nucleotide residues 70 to 1098 of SEQ ID NO: 423 (i.e., SEQ ID NO: 424), encodes a 343-amino acid transmembrane protein (SEQ ID NO: 425).

The invention includes nucleic acid molecules which encode a polypeptide of the invention. Such nucleic acids include, for example, a DNA molecule having the nucleotide sequence SEQ ID NO: 423 or some portion thereof, such as the portion which encodes INTERCEPT 296 protein or a domain thereof. These nucleic acids are collectively referred to as nucleic acids of the invention.

INTERCEPT 296 proteins and nucleic acid molecules encoding them comprise a family of molecules having certain conserved structural and functional features, such as the five transmembrane domains which occur in the protein.

INTERCEPT 296 comprises at least five transmembrane domains, at least three cytoplasmic domains, and at least two extracellular domains. INTERCEPT 296 does not appear to comprise a cleavable signal sequence. Amino acid residues 1 to 70 of SEQ ID NO: 425 likely directs insertion of the protein into the cytoplasmic membrane. There are at least two mechanisms by which this can occur. Sequence analysis of residues 1 to 70 of SEQ ID NO: 425 indicates that this entire region may represent a signal sequence or that residues 1 to 47 represent a signal sequence, with residues 48-70 representing a transmembrane region. Human INTERCEPT 296 protein extracellular domains are located from about amino acid residue 70 to about amino acid residue 182 (SEQ ID NO: 427) and from about amino acid residue 228 to about amino acid residue 249 (SEQ ID NO: 428) of SEQ ID NO: 425. Human INTERCEPT 296 cytoplasmic domains are located from about amino acid residue 43 to amino acid residue 50 (SEQ ID NO: 434), from about amino acid residue 205 to amino acid residue 210 (SEQ ID NO: 435), and from amino acid residue 272 to amino acid residue 343 (SEQ ID NO: 436) of SEQ ID NO: 425. The five transmembrane domains of INTERCEPT 296 are located from about amino acid residues 24 to 42 (SEQ ID NO: 429), 51 to 70 (SEQ ID NO: 430), 183 to 204 (SEQ ID NO: 431), 211 to 227 (SEQ ID NO: 432), and 250 to 271 (SEQ ID NO: 433) of SEQ ID NO: 425.

INTERCEPT 296 proteins typically comprise a variety of potential post-translational modification sites (often within an extracellular domain), such as those described herein in Table XXXII, as predicted by computerized sequence analysis of INTERCEPT 296 proteins using amino acid sequence comparison software (comparing the amino acid sequence of INTERCEPT 296 with the information in the PROSITE database {rel. 12.2; February 1995} and the Hidden Markov Models database {Rel. PFAM 3.3}). In certain embodiments, a protein of the invention has at least 1, 2, 4, 6, 10, 15, or 20 or more of the post-translational modification sites listed in Table XXXII.

TABLE XXXII

| Type of Potential Modification Site or Domain | Amino Acid Residues of SEQ ID NO: 425 | Amino Acid Sequence |
|---|---|---|
| N-glycosylation site | 71 to 74 | NFSS |
| | 84 to 87 | NTSY |
| | 109 to 112 | NITL |
| | 121 to 124 | NETI |
| | 284 to 287 | NQSV |
| Protein kinase C phosphorylation site | 86 to 88 | SYK |
| | 131 to 133 | TWR |
| | 162 to 164 | TPR |
| | 304 to 306 | SPR |
| | 313 to 315 | SPK |
| | 326 to 328 | STK |
| Casein kinase II phosphorylation site | 286 to 289 | SVDE |
| | 296 to 299 | SPEE |
| | 309 to 312 | SMAD |
| Tyrosine kinase phosphorylation site | 148 to 156 | KGLPDPVLY |
| | 79 to 84 | GQVSTN |
| N-myristoylation site | 100 to 105 | GLQVGL |
| | 107 to 112 | GVNITL |
| | 265 to 270 | GLAMAV |

FIG. 70A-70B depicts a hydrophobicity plot of INTERCEPT 296 protein. Relatively hydrophobic regions are above the dashed horizontal line, and relatively hydrophilic regions are below the dashed horizontal line. The hydrophobic regions which corresponds to amino acid residues 24 to 42, 51 to 70, 183 to 204, 211 to 227, and 250 to 271 of SEQ ID NO: 425 are the transmembrane domains of human INTERCEPT 296 (SEQ ID NOs: 429 through 433, respectively). As described elsewhere herein, relatively hydrophilic regions are generally located at or near the surface of a protein, and are more frequently effective immunogenic epitopes than are relatively hydrophobic regions. For example, the region of human INTERCEPT 296 protein from about amino acid residue 120 to about amino acid residue 140 appears to be located at or near the surface of the protein, while the region from about amino acid residue 95 to about amino acid residue 110 appears not to be located at or near the surface.

The predicted molecular weight of INTERCEPT 296 protein without modification and prior to cleavage of the signal sequence is about 37.8 kilodaltons. The predicted molecular weight of the mature INTERCEPT 296 protein without modification and after cleavage of the signal sequence is about 30.2 kilodaltons.

FIGS. 70A-70B depicts an alignment of the amino acid sequences of human INTERCEPT 296 protein (SEQ ID NO: 425) and *Caenorhabditis elegans* C06E1.3 related protein (SEQ ID NO: 410). In this alignment (pam120.mat scoring matrix, gap penalties −12/−4), the amino acid sequences of the proteins are 26.8% identical. The *C. elegans* protein has five predicted transmembrane domains.

Uses of INTERCEPT 296 Nucleic Acids,
Polypeptides, and Modulators Thereof

The cDNA encoding INTERCEPT 296 protein was obtained from a human esophagus cDNA library, and INTERCEPT 296 is expressed in lung tissue. The INTERCEPT 296-related proteins and nucleic acids of the invention are therefore useful for prevention, detection, and treatment of disorders of the human lung and esophagus. Examples of lung disorders in which INTERCEPT 296 can be involved include the lung disorders described elsewhere in this disclosure. Examples of disorders of the esophagus in which INTERCEPT 296 can be involved include dysphagia, achalasia, heartburn, symptomatic diffuse esophageal spasm, corrosive esophagitis, candidiasis, and gastroesophageal reflux disease.

Tables A-1, A-2 and B-1 to B-5 summarize sequence data corresponding to the human nucleic acids and proteins disclosed herein. Tables A-3 and B-6 summarize sequence data corresponding to the non-human nucleic acids and proteins disclosed herein.

TABLE A-1

| Protein Designation | SEQ ID NOs cDNA | ORF | Protein | ATCC® Accession # |
|---|---|---|---|---|
| TANGO 416 | 1 | 2 | 3 | PTA-1764 |
| TANGO416 (alt.form) | 32 | 32 | 33 | PTA-1764 |
| TANGO 457 | 51 | 52 | 53 | PTA-817 |
| TANGO 229 | 71 | 72 | 73 | PTA-295 |
| INTERCEPT 289 | | | | PTA-295 |
| form 1a | 81 | 82 | 83 | |
| form 1b | 91 | 92 | 93 | |
| form 2a | 96 | 97 | 98 | |
| form 2b | 101 | 102 | 103 | |
| form 3a | 106 | 107 | 108 | |
| form 3b | 111 | 112 | 113 | |
| INTERCEPT 309 | 121 | 122 | 123 | PTA-1156 |
| MANGO 419 | 141 | 142 | 143 | PTA-1156 |
| INTERCEPT 429 | 151 | 152 | 153 | PTA-455 |
| TANGO 210 | 171 | 172 | 173 | PTA-438 |
| TANGO 366 | 191 | 192 | 193 | PTA-424 |
| INTERCEPT 394 | 201 | 202 | 203 | PTA-424 |
| INTERCEPT 400 | 221 | 222 | 223 | PTA-438 |
| INTERCEPT 217 | 271 | 272 | 273 | PTA-147 |
| INTERCEPT 297 | 279 | 280 | 281 | PTA-147 |
| TANGO 276 | 303 | 304 | 305 | PTA-150 |
| TANGO 292 | 308 | 309 | 310 | 207230 |
| TANGO 331 | 324 | 325 | 326 | PTA-147 |

TABLE A-2

| Protein Designation | SEQ ID NOs cDNA | ORF | Protein | ATCC® Accession # |
|---|---|---|---|---|
| TANGO 332 | 329 | 330 | 331 | PTA-151 |
| TANGO 202 | 371 | 372 | 373 | 207219 |
| TANGO 234 | 379 | 380 | 381 | 207184 |
| TANGO 265 | 387 | 388 | 389 | 207228 |
| TANGO 286 | 403 | 404 | 405 | 207220 |
| TANGO 294 | 415 | 416 | 417 | 207220 |
| INTERCEPT 296 | 423 | 424 | 425 | 207220 |

TABLE A-3

| Protein Designation | SEQ ID NOs cDNA | ORF | Protein | ATCC® Accession # |
|---|---|---|---|---|
| murine INTERCEPT 289 | 161 | 162 | 163 | |
| murine TANGO 210 | 181 | 182 | 183 | |
| murine INTERCEPT 400 | 241 | 242 | 243 | |
| rat INTERCEPT 400 | 251 | 252 | 253 | |
| murine INTERCEPT 217 | | 362 | 363 | |
| gerbil TANGO 292 | 351 | 352 | 353 | |
| murine TANGO 202 | 437 | 438 | 439 | |

TABLE B-1

| Protein Desig. | Signal Sequence[1] | | Mature Protein | | Extracellular Domain(s)[2] | | Transmembrane Domain(s) | | Cytoplasmic Domain(s)[2] | |
|---|---|---|---|---|---|---|---|---|---|---|
| | SEQ ID NOs | | | | | | | | | |
| TANGO 416 (alternative form) | 1 to 27 (1 to 27) | 4 (4) | 28 to 1135 (28 to 1134) | 5 (35) | 28 to 700 (28 to 700) | 6 (6) | 701 to 721 (701 to 721) | 7 (7) | 722 to 1135 (722 to 1134) | 8 (38) |
| TANGO 457 | 1 to 24 | 55 | 25 to 365 | 54 | 283 to 365 | 60 | 265 to 282 | 59 | 25 to 264 | 56 |
| TANGO 229 | 1 to 34 | 74 | 35 to 715 | 75 | 35 to 455 | 76 | 456 to 480 | 77 | 481 to 715 | 78 |
| INTERCEPT 289 | | | | | | | | | | |
| form 1a | N/A | | 1 to 188 | 83 | 28 to 188 | 85 | 7 to 27 | 84 | | |
| form 1b | N/A | | 1 to 178 | 93 | 28 to 178 | 95 | 7 to 27 | 94 | | |
| form 2a | N/A | | 1 to 165 | 98 | 28 to 165 | 100 | 7 to 27 | 99 | | |
| form 2b | N/A | | 1 to 155 | 103 | 28 to 155 | 105 | 7 to 27 | 104 | | |
| form 3a | N/A | | 1 to 145 | 108 | 29 to 145 | 110 | 7 to 28 | 109 | | |
| form 3b | N/A | | 1 to 135 | 113 | 29 to 135 | 115 | 7 to 28 | 114 | | |
| INTERCEPT 309 | 1 to 24 | 124 | 25 to 215 | 138 | 25 to 71 132 to 153 154 to 178 | 125 129 | 27 to 92 108 to 131 | 126 128 130 | 93 to 107 179 to 215 | 127 131 |
| MANGO 419 | 1 to 24 | 144 | 25 to 80 | 145 | N/A | | N/A | | N/A | |
| | | | Amino Acid Residues | | | | | | | |

TABLE B-2

| Protein Desig. | Signal Sequence[1] | | Mature Protein | | Extracellular Domain(s)[2] | | Transmembrane Domain(s) | | Cytoplasmic Domain(s)[2] | |
|---|---|---|---|---|---|---|---|---|---|---|
| | | | | | SEQ ID NOs | | | | | |
| INTERCEPT 429 | 1 to 22 | 154 | 23 to 115 | 155 | 50 to 58 | 158 | 32 to 49 | 157 | 23 to 31 | 156 |
| | | | | | | | 59 to 82 | 159 | 83 to 115 | 160 |
| TANGO 210 | 1 to 17 | 174 | 18 to 513 | 175 | N/A | | N/A | | N/A | |
| (Alternate form) | 1 to 17 | 174 | 18 to 513 | 175 | 18 to 488 | 178 | 489 to 506 | 179 | 507 to 513 | 180 |
| TANGO 366 | 1 to 16 | 194 | 17 to 353 | 195 | 17 to 216 | 196 | 217 to 239 | 197 | 240 to 353 | 198 |
| INTERCEPT 394 | 1 to 25 | 204 | 26 to 778 | 205 | 88 to 228 | 208 | 71 to 87 | 207 | 26 to 70 | 206 |
| | | | | | 337 to 345 | 212 | 229 to 253 | 209 | 254 to 319 | 210 |
| | | | | | | | 320 to 336 | 211 | 365 to 778 | 214 |
| | | | | | | | 346 to 364 | 213 | | |
| INTERCEPT 217 | 1 to 20 | 274 | 21 to 455 | 275 | 21 to 383 | 276 | 384 to 403 | 277 | 404 to 455 | 278 |
| | | | | | Amino Acid Residues | | | | | |

TABLE B-3

| Protein Desig. | Signal Sequence[1] | | Mature Protein | | Extracellular Domain(s)[2] | | Transmembrane Domain(s) | | Cytoplasmic Domain(s)[2] | |
|---|---|---|---|---|---|---|---|---|---|---|
| | | | | | SEQ ID NOs | | | | | |
| INTERCEPT 400 | 1 to 46 | 224 | 47 to 265 | 225 | 47 to 62 | 226 | 63 to 79 | 227 | 80 to 136 | 228 |
| | | | | | 154 to 164 | 230 | 137 to 153 | 229 | 184 to 193 | 232 |
| | | | | | 218 to 231 | 234 | 165 to 183 | 231 | 252 to 265 | 236 |
| | | | | | | | 194 to 217 | 233 | | |
| | | | | | | | 232 to 251 | 235 | | |
| INTERCEPT 297 | (1 to 18) | (282) | 19 to 371 | 283 | 19 to 47 | 284 | (1 to 18) | (12) | 69 to 88 | 298 |
| | | | | | 110 to 118 | 285 | 48 to 68 | 289 | 138 to 144 | 299 |
| | | | | | 162 to 175 | 286 | 89 to 109 | 290 | 193 to 215 | 300 |
| | | | | | 234 to 260 | 287 | 119 to 137 | 291 | 284 to 292 | 301 |
| | | | | | 313 to 319 | 288 | 145 to 161 | 292 | 337 to 371 | 302 |
| | | | | | | | 176 to 192 | 293 | | |
| | | | | | | | 216 to 233 | 294 | | |
| | | | | | | | 261 to 283 | 295 | | |
| | | | | | | | 293 to 312 | 296 | | |
| | | | | | | | 320 to 336 | 297 | | |
| | | | | | Amino Acid Residues | | | | | |

TABLE B-4

| Protein Desig. | Signal Sequence[1] | | Mature Protein | | Extracellular Domain(s)[2] | | Transmembrane Domain(s) | | Cytoplasmic Domain(s)[2] | |
|---|---|---|---|---|---|---|---|---|---|---|
| | | | | | SEQ ID NOs | | | | | |
| TANGO 276 | 1 to 20 | 306 | 21 to 243 | 307 | 21 to 243 | 307 | N/A | | N/A | |
| TANGO 292 | 1 to 17 | 311 | 18 to 226 | 312 | 18 to 113 | 313 | 114 to 138 | 314 | 139 to 226 | 315 |
| TANGO 331 | 1 to 24 | 327 | 25 to 353 | 328 | 25 to 353 | 328 | N/A | | N/A | |
| TANGO 332 | 1 to 22 | 332 | 23 to 671 | 333 | 23 to 671 | 333 | N/A | | N/A | |
| TANGO 202 | 1 to 19 | 374 | 20 to 475 | 375 | 20 to 392 | 376 | 393 to 415 | 377 | 416 to 475 | 378 |
| (variant) | (1 to 19) | (374) | (20 to 475) | (375) | (20 to 475) | (375) | (N/A) | | (N/A) | |
| TANGO 234 | 1 to 40 | 382 | 41 to 1453 | 383 | 41 to 1359 | 384 | 1360 to 1383 | 385 | 1384 to 1453 | 386 |
| TANGO 265 | 1 to 32 | 390 | 32 to 761 | 391 | 32 to 683 | 392 | 684 to 704 | 393 | 705 to 761 | 394 |
| TANGO 286 | 1 to 23 | 406 | 24 to 455 | 407 | 24 to 455 | 407 | N/A | | N/A | |
| | | | | | Amino Acid Residues | | | | | |

TABLE B-5

| Protein Desig. | Signal Sequence[1] | | Mature Protein | | Extracellular Domain(s)[2] | | Transmembrane Domain(s) | | Cytoplasmic Domain(s)[2] | |
|---|---|---|---|---|---|---|---|---|---|---|
| | SEQ ID NOs | | | | | | | | | |
| TANGO 294 (variant 1) <variant 2> {variant 3} | 1 to 33 (15 to 33) <1 to 33> {15 to 33} | 418 (410) <418> {410} | 34 to 423 (34 to 423) <34 to 423> {34 to 423} | 419 (419) <419> {419} | 34 to 254 (34 to 254) <34 to 423> {34 to 423} | 420 (420) <419> {419} | 255 to 279 (255 to 279) <N/A> {N/A} | 421 (421) | 280 to 423 (280 to 423) <N/A> {N/A} | 422 (422) |
| INTERCEPT 296 | N/A | | 1 to 343 | 425 | 1 to 23 71 to 182 228 to 249 | 426 427 428 | 24 to 42 51 to 70 183 to 204 211 to 227 250 to 271 | 429 430 431 432 433 | 43 to 50 205 to 210 272 to 343 | 434 435 436 |
| | | | | | Amino Acid Residues | | | | | |

TABLE B-6

| Protein Desig. | Signal Sequence[1] | | Mature Protein | | Extracellular Domain(s)[2] | | Transmembrane Domain(s) | | Cytoplasmic Domain(s)[2] | |
|---|---|---|---|---|---|---|---|---|---|---|
| | SEQ ID NOs | | | | | | | | | |
| murine INTERCEPT 289 | N/A | | 1 to 190 | 163 | 28 to 190 | 165 | 7 to 27 | 164 | | |
| murine TANGO 210 | 1 to 17 | 184 | 18 to 513 | 185 | N/A | | N/A | | N/A | |
| murine INTERCEPT 400 | N/A | | 1 to 180 | 243 | 61 to 71 125 to 140 | 246 250 | 44 to 60 72 to 90 101 to 124 141 to 160 | 2452 47 249 251 | 1 to 43 91 to 100 161 to 180 | 244 248 252 |
| murine INTERCEPT 217 | 1 to 15 | 364 | 16 to 320 | 365 | 17 to 213 | 366 | 214 to 233 | 367 | 234 to 320 | 368 |
| gerbil TANGO 292 | 1 to 17 | 354 | 18 to 225 | 355 | 18 to 112 | 356 | 113 to 137 | 357 | 138 to 225 | 358 |
| murine TANGO 202 | 1 to 19 | 412 | 20 to 470 | 413 | N/A | | N/A | | N/A | |
| | | | | | Amino Acid Residues | | | | | |

Notes for Tables B-1 to B-6:
[1]It is recognized that the carboxyl terminal boundary of the signal sequence can be ± 1 or 2 residues from that indicated.
[2]It is recognized that 'extracellular' and cytoplasmic' domains can have the opposite orientation in certain embodiments, as described herein.

Various aspects of the invention are described in further detail in the following subsections.

I. Isolated Nucleic Acid Molecules

One aspect of the invention pertains to isolated nucleic acid molecules that encode a polypeptide of the invention or a biologically active portion thereof, as well as nucleic acid molecules sufficient for use as hybridization probes to identify nucleic acid molecules encoding a polypeptide of the invention and fragments of such nucleic acid molecules suitable for use as PCR primers for the amplification or mutation of nucleic acid molecules.

As used herein, the term "nucleic acid molecule" is intended to include DNA molecules (e.g., cDNA or genomic DNA) and RNA molecules (e.g., mRNA) and analogs of the DNA or RNA generated using nucleotide analogs. The nucleic acid molecule can be single-stranded or double-stranded. An "isolated" nucleic acid molecule is one which is separated from other nucleic acid molecules which are present in the natural source of the nucleic acid molecule. Preferably, an "isolated" nucleic acid molecule is free of sequences (preferably protein-encoding sequences) which naturally flank the nucleic acid (i.e., sequences located at the 5' and 3' ends of the nucleic acid) in the genomic DNA of the organism from which the nucleic acid is derived. For example, in various embodiments, the isolated nucleic acid molecule can contain less than about 5, 4, 3, 2, 1, 0.5, or 0.1 kilobases of nucleotide sequences which naturally flank the nucleic acid molecule in genomic DNA of the cell from which the nucleic acid is derived. Moreover, an "isolated" nucleic acid molecule, such as a cDNA molecule, can be substantially free of other cellular material, or culture medium when produced by recombinant techniques, or substantially free of chemical precursors or other chemicals when chemically synthesized.

A nucleic acid molecule of the present invention, e.g., a nucleic acid molecule having the nucleotide sequence of all or a portion of any of SEQ ID NOs: 1, 2, 31, 32, 51, 52, 71, 72, 81, 82, 91, 92, 96, 97, 101, 102, 106, 107, 111, 112, 121, 122, 141, 142, 151, 152, 161, 162, 171, 172, 181, 182, 191, 192, 201, 202, 215, 217, 221, 222, 241, 242, 251, 252, 271, 272, 279, 280, 303, 304, 308, 309, 324, 325, 329, 330, 351, 352, 362, 371, 372, 379, 380, 387, 388, 403, 404, 415, 416, 423, 424, 437, 438, and the nucleotide sequence of any of the clones deposited as ATCC® Accession numbers 207184, 207219, 207220, 207221, 207228, 207230, PTA-147, PTA-150, PTA-151, PTA-295, PTA-424, PTA-438, PTA-455, PTA-817, PTA-1156, and PTA-1764, or a complement thereof, or which has a nucleotide sequence comprising one of these sequences, can be isolated using standard molecular biology techniques and the sequence information provided herein. Using all or a portion of the nucleic acid sequences of any of SEQ ID NOs: 1, 2, 31, 32, 51, 52, 71, 72, 81, 82, 91, 92, 96, 97, 101, 102, 106, 107, 111, 112, 121, 122, 141, 142, 151, 152, 161, 162, 171, 172, 181, 182, 191, 192, 201, 202, 215, 217, 221, 222, 241, 242, 251, 252, 271, 272, 279, 280, 303, 304, 308, 309, 324, 325, 329, 330, 351, 352, 362, 371, 372, 379, 380, 387, 388, 403, 404, 415, 416, 423, 424, 437, 438, and the nucleotide sequence of any of the clones deposited as ATCC® Accession numbers 207184, 207219, 207220, 207221, 207228, 207230, PTA-147, PTA-150, PTA-151, PTA-295, PTA-424, PTA-438, PTA-455, PTA-817, PTA-1156, and PTA-1764 as a hybridization probe, nucleic acid molecules of the invention can be isolated using standard hybridization and cloning techniques (e.g., as described in Sambrook et al., Eds., Molecular Cloning: A Laboratory Manual, 2nd ed., Cold Spring Harbor Laboratory, Cold Spring Harbor Laboratory Press, Cold Spring Harbor, N.Y., 1989).

A nucleic acid molecule of the invention can be amplified using cDNA, mRNA, or genomic DNA as a template and appropriate oligonucleotide primers according to standard PCR amplification techniques. The nucleic acid so amplified can be cloned into an appropriate vector and characterized by DNA sequence analysis. Furthermore, oligonucleotides corresponding to all or a portion of a nucleic acid molecule of the invention can be prepared by standard synthetic techniques, e.g., using an automated DNA synthesizer.

In another embodiment, an isolated nucleic acid molecule of the invention comprises a nucleic acid molecule which is a complement of the nucleotide sequence of any of SEQ ID NOs: 1, 2, 31, 32, 51, 52, 71, 72, 81, 82, 91, 92, 96, 97, 101, 102, 106, 107, 111, 112, 121, 122, 141, 142, 151, 152, 161, 162, 171, 172, 181, 182, 191, 192, 201, 202, 215, 217, 221, 222, 241, 242, 251, 252, 271, 272, 279, 280, 303, 304, 308, 309, 324, 325, 329, 330, 351, 352, 362, 371, 372, 379, 380, 387, 388, 403, 404, 415, 416, 423, 424, 437, 438, and the nucleotide sequence of any of the clones deposited as ATCC® Accession numbers 207184, 207219, 207220, 207221, 207228, 207230, PTA-147, PTA-150, PTA-151, PTA-295, PTA-424, PTA-438, PTA-455, PTA-817, PTA-1156, and PTA-1764, or a portion thereof. A nucleic acid molecule which is complementary to a given nucleotide sequence is one which is sufficiently complementary to the given nucleotide sequence that it can hybridize with the given nucleotide sequence thereby forming a stable duplex.

Moreover, a nucleic acid molecule of the invention can comprise a portion of a nucleic acid sequence encoding a full length polypeptide of the invention, such as a fragment which can be used as a probe or primer or a fragment encoding a biologically active portion of a polypeptide of the invention. The nucleotide sequence determined from cloning one gene allows generation of probes and primers designed for identifying and/or cloning homologs in other cell types, e.g., from other tissues, as well as homologs from other mammals. The probe/primer typically comprises substantially purified oligonucleotide. The oligonucleotide typically comprises a region of nucleotide sequence that hybridizes under stringent conditions with at least about 15, preferably about 25, more preferably about 40, 60, 80, 100, 150, 200, 250, 300, 350, 400, 450, 550, 650, 700, 800, 900, 1000, 1200, 1400, 1410, 1600, 1800, 2000, 2200, 2400, 2600, 2800, 3000, 3500, 4000, 4500, or 5000 or more-consecutive nucleotides of the sense or antisense sequence of any of SEQ ID NOs: 1, 2, 31, 32, 51, 52, 71, 72, 81, 82, 91, 92, 96, 97, 101, 102, 106, 107, 111, 112, 121, 122, 141, 142, 151, 152, 161, 162, 171, 172, 181, 182, 191, 192, 201, 202, 215, 217, 221, 222, 241, 242, 251, 252, 271, 272, 279, 280, 303, 304, 308, 309, 324, 325, 329, 330, 351, 352, 362, 371, 372, 379, 380, 387, 388, 403, 404, 415, 416, 423, 424, 437, 438, and the nucleotide sequence of any of the clones deposited as ATCC® Accession numbers 207184, 207219, 207220, 207221, 207228, 207230, PTA-147, PTA-150, PTA-151, PTA-295, PTA-424, PTA-438, PTA-455, PTA-817, PTA-1156, and PTA-1764, or of a naturally occurring mutant of any of these sequences.

Probes based on the sequence of a nucleic acid molecule of the invention can be used to detect transcripts or genomic sequences encoding the same protein molecule encoded by a selected nucleic acid molecule. The probe comprises a label group attached thereto, e.g., a radioisotope, a fluorescent compound, an enzyme, or an enzyme co-factor. Such probes can be used as part of a diagnostic test kit for identifying cells or tissues which aberrantly express the protein, such as by measuring levels of a nucleic acid molecule encoding the protein in a sample of cells from a subject, e.g., detecting mRNA levels or determining whether a gene encoding the protein has been mutated or deleted.

A nucleic acid fragment encoding a biologically active portion of a polypeptide of the invention can be prepared by isolating a portion of one of SEQ ID NOs: 2, 32, 52, 72, 82, 92, 97, 102, 107, 112, 122, 142, 152, 162, 172, 182, 192, 202, 215, 222, 242, 252, 272, 280, 304, 309, 325, 330, 352, 362, 372, 380, 388, 404, 416, 424, and 438 expressing the encoded portion of the polypeptide protein (e.g., by recombinant expression in vitro), and assessing the activity of the encoded portion of the polypeptide.

The invention further encompasses nucleic acid molecules that differ from the nucleotide sequence of any of SEQ ID NOs: 1, 2, 31, 32, 51, 52, 71, 72, 81, 82, 91, 92, 96, 97, 101, 102, 106, 107, 111, 112, 121, 122, 141, 142, 151, 152, 161, 162, 171, 172, 181, 182, 191, 192, 201, 202, 215, 217, 221, 222, 241, 242, 251, 252, 271, 272, 279, 280, 303, 304, 308, 309, 324, 325, 329, 330, 351, 352, 362, 371, 372, 379, 380, 387, 388, 403, 404, 415, 416, 423, 424, 437, 438, and the nucleotide sequence of any of the clones deposited as ATCC® Accession numbers 207184, 207219, 207220, 207221, 207228, 207230, PTA-147, PTA-150, PTA-151, PTA-295, PTA-424, PTA-438, PTA-455, PTA-817, PTA-1156, and PTA-1764, due to degeneracy of the genetic code and thus encode the same protein as that encoded by the nucleotide sequence of one of SEQ ID NOs: 2, 32, 52, 72, 82, 92, 97, 102, 107, 112, 122, 142, 152, 162, 172, 182, 192, 202, 215, 222, 242, 252, 272, 280, 304, 309, 325, 330, 352, 362, 372, 380, 388, 404, 416, 424, and 438.

In addition to the nucleotide sequences of one of SEQ ID NOs: 2, 32, 52, 72, 82, 92, 97, 102, 107, 112, 122, 142, 152, 162, 172, 182, 192, 202, 215, 222, 242, 252, 272, 280, 304, 309, 325, 330, 352, 362, 372, 380, 388, 404, 416, 424, and 438, it will be appreciated by those skilled in the art that DNA sequence polymorphisms that lead to changes in the amino acid sequence can exist within a population (e.g., the human population). Such genetic polymorphisms can exist among individuals within a population due to natural allelic variation. An allele is one of a group of genes which occur alternatively at a given genetic locus.

To determine the percent identity of two amino acid sequences or of two nucleic acids, the sequences are aligned for optimal comparison purposes (e.g., gaps can be introduced in the sequence of a first amino acid or nucleic acid sequence for optimal alignment with a second amino or nucleic acid sequence). The amino acid residues or nucleotides at corresponding amino acid positions or nucleotide positions are then compared. When a position in the first sequence is occupied by the same amino acid residue or nucleotide as the corresponding position in the second sequence, then the molecules are identical at that position. The percent identity between the two sequences is a function of the number of identical positions shared by the sequences (i.e., % identity=# of identical positions/total # of positions {e.g., overlapping positions}×100). In one embodiment, the two sequences are the same length.

The determination of percent identity between two sequences can be accomplished using a mathematical algorithm. A preferred, non-limiting example of a mathematical algorithm utilized for the comparison of two sequences is the algorithm of Karlin and Altschul (1990) Proc. Natl. Acad. Sci. USA 87:2264-2268, modified as in Karlin and Altschul (1993) Proc. Natl. Acad. Sci. USA 90:5873-5877. Such an algorithm is incorporated into the NBLAST and XBLAST programs of Altschul, et al. (1990) J. Mol. Biol. 215:403-410. BLAST nucleotide searches can be performed with the NBLAST program, score=100, wordlength=12 to obtain nucleotide sequences homologous to a nucleic acid molecules of the invention.

BLAST protein searches can be performed with the XBLAST program, score=50, wordlength=3 to obtain amino acid sequences homologous to a protein molecules of the invention. To obtain gapped alignments for comparison purposes, Gapped BLAST can be utilized as described in Altschul et al. (1997) Nucleic Acids Res. 25:3389-3402. Alternatively, PSI-Blast can be used to perform an iterated search which detects distant relationships between molecules (Id.). When utilizing BLAST, Gapped BLAST, and PSI-Blast programs, the default parameters of the respective programs (e.g., XBLAST and NBLAST) can be used.

Another preferred, non-limiting example of a mathematical algorithm utilized for the comparison of sequences is the local homology algorithm of Smith and Waterman (Advances in Applied Mathematics 2: 482-489 (1981)). Such an algorithm is incorporated into the BestFit program, which is part of the Wisconsin™ package, and is used to find the best segment of similarity between two sequences. BestFit reads a scoring matrix that contains values for every possible GCG symbol match. The program uses these values to construct a path matrix that represents the entire surface of comparison with a score at every position for the best possible alignment to that point. The quality score for the best alignment to any point is equal to the sum of the scoring matrix values of the matches in that alignment, less the gap creation penalty multiplied by the number of gaps in that alignment, less the gap extension penalty multiplied by the total length of all gaps in that alignment. The gap creation and gap extension penalties are set by the user. If the best path to any point has a negative value, a zero is put in that position.

After the path matrix is complete, the highest value on the surface of comparison represents the end of the best region of similarity between the sequences. The best path from this highest value backwards to the point where the values revert to zero is the alignment shown by BestFit. This alignment is the best segment of similarity between the two sequences.

Additional algorithms for sequence analysis are known in the art and include ADVANCE and ADAM as described in Torellis and Robotti (1994) Comput. Appl. Biosci., 10:3-5; and FASTA described in Pearson and Lipman (1988) Proc. Natl. Acad. Sci. 85:2444-8. Within FASTA, ktup is a control option that sets the sensitivity and speed of the search. If ktup=2, similar regions in the two sequences being compared are found by looking at pairs of aligned residues; if ktup=1, single aligned amino acids are examined. ktup can be set to 2 or 1 for protein sequences, or from 1 to 6 for DNA sequences. The default if ktup is not specified is 2 for proteins and 6 for DNA.

The percent identity between two sequences can be determined using techniques similar to those described above, with or without allowing gaps. In calculating percent identity, typically exact matches are counted.

As used herein, the phrase "allelic variant" refers to a nucleotide sequence which occurs at a given locus or to a polypeptide encoded by the nucleotide sequence. For example, the TANGO 457 gene exhibits significant homology with a portion of human chromosome 11p14.3 PAC present in a clone designated pDJ239b22 and having GENBANK™ accession number AC003969; the TANGO 416 gene exhibits significant homology with a portion of chromosome 4 between chromosomal markers D4S422 and D4S1576; the INTERCEPT 400 gene exhibits significant homology with a portion of chromosome 4 between markers D4S1616 and D4S1611; the TANGO 331 gene exhibits significant homology with a portion of chromosome 22 at 22q13-q13, between markers WI-4572 and WI-8917; the TANGO 265 gene exhibits significant homology with a portion of chromosome 1 between markers D1S305 and D1S2635; and the TANGO 286 gene exhibits significant homology with a portion of chromosome 22 at 22q12-13. Allelic variants of any of these genes can be identified by sequencing the corresponding chromosomal portion at the indicated location in multiple individuals.

As used herein, the terms "gene" and "recombinant gene" refer to nucleic acid molecules comprising an open reading frame encoding a polypeptide of the invention. Such natural allelic variations can typically result in 1-5% variance in the nucleotide sequence of a given gene. Alternative alleles can be identified by sequencing the gene of interest in a number of different individuals. This can be readily carried out by using hybridization probes to identify the same genetic locus in a variety of individuals. Any and all such nucleotide variations and resulting amino acid polymorphisms or variations that are the result of natural allelic variation and that do not alter the functional activity are intended to be within the scope of the invention.

Moreover, nucleic acid molecules encoding proteins of the invention from other species (homologs), which have a nucleotide sequence which differs from that of the human proteins described herein are within the scope of the invention. Nucleic acid molecules corresponding to natural allelic variants and homologs of a cDNA of the invention can be isolated based on their identity to human nucleic acid molecules using the human cDNAs, or a portion thereof, as a hybridization probe according to standard hybridization techniques under stringent hybridization conditions. For example, a cDNA encoding a soluble form of a membrane-bound protein of the invention can be isolated based on its hybridization with a nucleic acid molecule encoding all or part of the membrane-bound form. Likewise, a cDNA encoding a membrane-bound form can be isolated based on its hybridization with a nucleic acid molecule encoding all or part of the soluble form.

Accordingly, in another embodiment, an isolated nucleic acid molecule of the invention is at least 15 (25, 40, 60, 80, 100, 150, 200, 250, 300, 350, 400, 450, 500, 600, 700, 800, 900, 1000, 1200, 1400, 1600, 1800, 2000, 2200, 2400, 2600, 2800, 3000, 3500, 4000, 4500, 5000, or more) nucleotides in length and hybridizes under stringent conditions to the nucleic acid molecule comprising the nucleotide sequence, preferably the coding sequence, of any of SEQ ID NOs: 1, 2, 31, 32, 51, 52, 71, 72, 81, 82, 91, 92, 96, 97, 101, 102, 106, 107, 111, 112, 121, 122, 141, 142, 151, 152, 161, 162, 171, 172, 181, 182, 191, 192, 201, 202, 215, 217, 221, 222, 241, 242, 251, 252, 271, 272, 279, 280, 303, 304, 308, 309, 324, 325, 329, 330, 351, 352, 362, 371, 372, 379, 380, 387, 388, 403, 404, 415, 416, 423, 424, 437, 438, and the nucleotide sequence of any of the clones deposited as ATCC® Accession numbers 207184, 207219, 207220, 207221, 207228, 207230, PTA-147, PTA-150, PTA-151, PTA-295, PTA-424, PTA-438, PTA-455, PTA-817, PTA-1156, and PTA-1764, or a complement thereof. As used herein, the term "hybridizes under stringent conditions" is intended to describe conditions for hybridization and washing under which nucleotide sequences at least 60% (65%, 70%, preferably 75%) identical to each other typically remain hybridized with each other. Such stringent conditions are known to those skilled in the art and can be found in Current Protocols in Molecular Biology, John Wiley & Sons, N.Y. (1989), 6.3.1-6.3.6. A example of stringent hybridization conditions are hybridization in 6× sodium chloride/sodium citrate (SSC) at about 45° C., followed by one or more washes in 0.2×SSC, 0.1% SDS at 50-65° C. Preferably, an isolated nucleic acid molecule of the invention that hybridizes under stringent conditions to the sequence of any of SEQ ID NOs: 1, 2, 31, 32, 51, 52, 71, 72, 81, 82, 91, 92, 96, 97, 101, 102, 106, 107, 111, 112, 121, 122, 141, 142, 151, 152, 161, 162, 171, 172, 181, 182, 191, 192, 201, 202, 215, 217, 221, 222, 241, 242, 251, 252, 271, 272, 279, 280, 303, 304, 308, 309, 324, 325, 329, 330, 351, 352, 362, 371, 372, 379, 380, 387, 388, 403, 404, 415, 416, 423, 424, 437, 438, and the nucleotide sequence of any of the clones deposited as ATCC® Accession numbers 207184, 207219, 207220, 207221, 207228, 207230, PTA-147, PTA-150, PTA-151, PTA-295, PTA-424, PTA-438, PTA-455, PTA-817, PTA-1156, and PTA-1764, or a complement thereof, corresponds to a naturally-occurring nucleic acid molecule. As used herein, a "naturally-occurring" nucleic acid molecule refers to an RNA or DNA molecule having a nucleotide sequence that occurs in nature (e.g., encodes a natural protein).

In addition to naturally-occurring allelic variants of a nucleic acid molecule of the invention sequence that can exist in the population, the skilled artisan will further appreciate that changes can be introduced by mutation thereby leading to changes in the amino acid sequence of the encoded protein, without altering the biological activity of the protein. For example, one can make nucleotide substitutions leading to amino acid substitutions at "non-essential" amino acid residues. A "non-essential" amino acid residue is a residue that can be altered from the wild-type sequence without altering the biological activity, whereas an "essential" amino acid residue is required for biological activity. For example, amino acid residues that are not conserved or only semi-conserved among homologs of various species may be non-essential for activity and thus would be likely targets for alteration. Alternatively, amino acid residues that are conserved among the homologs of various species (e.g., murine and human) may be essential for activity and thus would not be likely targets for alteration.

Accordingly, another aspect of the invention pertains to nucleic acid molecules encoding a polypeptide of the invention that contain changes in amino acid residues that are not essential for activity. Such polypeptides differ in amino acid sequence from any of SEQ ID NOs: 3-8, 33, 35, 38, 53-60, 73-78, 83-85, 93-95, 98-100, 103-105, 108-110, 113-115, 123-131, 143-145, 153-160, 163, 173-175, 183-185, 193-198, 203-214, 216, 223-236, 243-252, 253, 273-278, 281-302, 305-307, 310-315, 326-328, 331-333, 353-358, 363-368, 373-378, 381-386, 389-394, 405-414, 417-422, 425-436, and 439, yet retain biological activity. In one embodiment, the isolated nucleic acid molecule includes a nucleotide sequence encoding a protein that includes an amino acid sequence that is at least about 40% identical, 50%, 60%, 70%, 80%, 90%, 95%, or 98% identical to the amino acid sequence of any of SEQ ID NOs: 3-8, 33, 35, 38, 53-60, 73-78, 83-85, 93-95, 98-100, 103-105, 108-110, 113-115, 123-131, 143-145, 153-160, 163, 173-175, 183-185, 193-198, 203-214, 216, 223-236, 243-252, 253, 273-278, 281-302, 305-307, 310-315, 326-328, 331-333, 353-358, 363-368, 373-378, 381-386, 389-394, 405-414, 417-422, 425-436, and 439, or the amino acid sequence encoded by the nucleotide sequence of any of the clones deposited as ATCC® Accession numbers 207184, 207219, 207220, 207221, 207228, 207230, PTA-147, PTA-150, PTA-151, PTA-295, PTA-424, PTA-438, PTA-455, PTA-817, PTA-1156, and PTA-1764.

An isolated nucleic acid molecule encoding a variant protein can be created by introducing one or more nucleotide substitutions, additions or deletions into the nucleotide sequence of any of SEQ ID NOs: 1, 2, 31, 32, 51, 52, 71, 72, 81, 82, 91, 92, 96, 97, 101, 102, 106, 107, 111, 112, 121, 122, 141, 142, 151, 152, 161, 162, 171, 172, 181, 182, 191, 192, 201, 202, 215, 217, 221, 222, 241, 242, 251, 252, 271, 272, 279, 280, 303, 304, 308, 309, 324, 325, 329, 330, 351, 352, 362, 371, 372, 379, 380, 387, 388, 403, 404, 415, 416, 423, 424, 437, 438, and the nucleotide sequence of any of the clones deposited as ATCC® Accession numbers 207184, 207219, 207220, 207221, 207228, 207230, PTA-147, PTA-150, PTA-151, PTA-295, PTA-424, PTA-438, PTA-455, PTA-817, PTA-1156, and PTA-1764, such that one or more amino acid residue substitutions, additions or deletions are introduced into the encoded protein. Mutations can be introduced by standard techniques, such as site-directed mutagenesis and PCR-mediated mutagenesis. Preferably, conservative amino acid substitutions are made at one or more predicted non-essential amino acid residues. A "conservative amino acid substitution" is one in which the amino acid residue is replaced with an amino acid residue having a similar side chain. Families of amino acid residues having similar side chains have been defined in the art. These families include amino acids with basic side chains (e.g., lysine, arginine, histidine), acidic side chains (e.g., aspartic acid, glutamic acid), uncharged polar side chains (e.g., glycine, asparagine, glutamine, serine, threonine, tyrosine, cysteine), non-polar side chains (e.g., alanine, valine, leucine, isoleucine, proline, phenylalanine, methionine, tryptophan), beta-branched side chains (e.g., threonine, valine, isoleucine) and aromatic side chains (e.g., tyrosine, phenylalanine, tryptophan, histidine). Alternatively, mutations can be introduced randomly along all or part of the coding sequence, such as by saturation mutagenesis, and the resultant mutants can be screened for biological activity to identify mutants that retain activity. Following mutagenesis, the encoded protein can be expressed recombinantly and the activity of the protein can be determined.

In one embodiment, a mutant polypeptide that is a variant of a polypeptide of the invention can be assayed for: (1) the ability to form protein:protein interactions with a polypeptide of the invention; (2) the ability to bind a ligand of a polypeptide of the invention; (3) the ability to bind with a modulator or substrate of a polypeptide of the invention; (4) the ability to modulate a physiological activity of a polypeptide of the invention, such as one of those disclosed herein; or (5) the ability to catalyze a reaction catalyzed by a polypeptide of the invention.

The present invention encompasses antisense nucleic acid molecules, i.e., molecules which are complementary to a sense nucleic acid encoding a polypeptide of the invention, e.g., complementary to the coding strand of a double-stranded cDNA molecule or complementary to an mRNA sequence. Accordingly, an antisense nucleic acid can hydrogen bond to a sense nucleic acid. The antisense nucleic acid can be complementary to an entire coding strand, or to only a portion thereof, e.g., all or part of the protein coding region (or open reading frame). An antisense nucleic acid molecule can be antisense to all or part of a non-coding region of the coding strand of a nucleotide sequence encoding a polypeptide of the invention. The non-coding regions ("5' and 3'non-translated regions") are the 5' and 3' sequences which flank the coding region and are not translated into amino acids.

An antisense oligonucleotide can be, for example, about 5, 10, 15, 20, 25, 30, 35, 40, 45, or 50 or more nucleotides in length. An antisense nucleic acid of the invention can be constructed using chemical synthesis and enzymatic ligation reactions using procedures known in the art. For example, an antisense nucleic acid (e.g., an antisense oligonucleotide) can be chemically synthesized using naturally occurring nucleotides or variously modified nucleotides designed to increase the biological stability of the molecules or to increase the physical stability of the duplex formed between the antisense and sense nucleic acids, e.g., phosphorothioate derivatives and acridine substituted nucleotides can be used. Examples of modified nucleotides which can be used to generate the antisense nucleic acid include 5-fluorouracil, 5-bromouracil, 5-chlorouracil, 5-iodouracil, hypoxanthine, xanthine, 4-acetylcytosine, 5-(carboxyhydroxylmethyl) uracil, 5-carboxymethylaminomethyl-2-thiouridine, 5-carboxymethylaminomethyluracil, dihydrouracil, beta-D-galactosylqueosine, inosine, N6-isopentenyladenine, 1-methylguanine, 1-methylinosine, 2,2-dimethylguanine, 2-methyladenine, 2-methylguanine, 3-methylcytosine, 5-methylcytosine, N6-adenine, 7-methylguanine, 5-methylaminomethyluracil, 5-methoxyaminomethyl-2-thiouracil, beta-D-mannosylqueosine, 5'-methoxycarboxymethyluracil, 5-methoxyuracil, 2-methylthio-N-6-isopentenyladenine, uracil-5-oxyacetic acid (v), wybutoxosine, pseudouracil, queosine, 2-thiocytosine, 5-methyl-2-thiouracil, 2-thiouracil, 4-thiouracil, 5-methyluracil, uracil-5-oxyacetic acid methylester, uracil-5-oxyacetic acid (v), 5-methyl-2-thiouracil, 3-(3-amino-3-N-2-carboxypropyl) uracil, (acp3)w, and 2,6-diaminopurine. Alternatively, the antisense nucleic acid can be produced biologically using an expression vector into which a nucleic acid has been subcloned in an antisense orientation (i.e., RNA transcribed from the inserted nucleic acid will be of an antisense orientation to a target nucleic acid of interest, described further in the following subsection).

The antisense nucleic acid molecules of the invention are typically administered to a subject or generated in situ such that they hybridize with or bind with cellular mRNA and/or genomic DNA encoding a selected polypeptide of the invention to thereby inhibit expression, e.g., by inhibiting transcription and/or translation. The hybridization can be by conventional nucleotide complementarity to form a stable duplex, or, for example, in the case of an antisense nucleic acid molecule which binds with DNA duplexes, through specific interactions in the major groove of the double helix. An example of a route of administration of antisense nucleic acid molecules of the invention includes direct injection at a tissue site. Alternatively, antisense nucleic acid molecules can be modified to target selected cells and then administered systemically. For example, for systemic administration, antisense molecules can be modified such that they specifically bind with receptors or antigens expressed on a selected cell surface, e.g., by linking the antisense nucleic acid molecules to peptides or antibodies which bind with cell surface receptors or antigens. The antisense nucleic acid molecules can also be delivered to cells using the vectors described herein. To achieve sufficient intracellular concentrations of the antisense molecules, vector constructs in which the antisense nucleic acid molecule is placed under the control of a strong pol II or pol III promoter are preferred.

An antisense nucleic acid molecule of the invention can be an α-anomeric nucleic acid molecule. An α-anomeric nucleic acid molecule forms specific double-stranded hybrids with complementary RNA in which the strands run parallel to each other (Gaultier et al. (1987) Nucleic Acids Res. 15:6625-6641). The antisense nucleic acid molecule can also comprise a 2'-o-methylribonucleotide (Inoue et al. (1987) Nucleic Acids Res. 15:6131-6148) or a chimeric RNA-DNA analogue (Inoue et al. (1987) FEBS Lett. 215:327-330).

The invention also encompasses ribozymes. Ribozymes are catalytic RNA molecules which are capable of cleaving a single-stranded nucleic acid, such as an mRNA, to which they have a complementary region. Thus, ribozymes (e.g., hammerhead ribozymes as described in Haselhoff and Gerlach (1988) Nature 334:585-591) can be used to catalytically cleave mRNA transcripts to thereby inhibit translation of the protein encoded by the mRNA. A ribozyme having specificity for a nucleic acid molecule encoding a polypeptide of the invention can be designed based upon the nucleotide sequence of a cDNA disclosed herein. For example, a derivative of a Tetrahymena L-19 IVS RNA can be constructed in which the nucleotide sequence of the ribozyme active site is complementary to the nucleotide sequence to be cleaved, as described in Cech et al. U.S. Pat. No. 4,987,071; and Cech et al. U.S. Pat. No. 5,116,742. Alternatively, an mRNA encoding a polypeptide of the invention can be used to select a catalytic RNA having a specific ribonuclease activity from a pool of RNA molecules. See, e.g., Bartel and Szostak (1993) Science 261:1411-1418.

The invention includes nucleic acid molecules which form triple helical structures. For example, expression of a polypeptide of the invention can be inhibited by targeting nucleotide sequences complementary to the regulatory region of the gene encoding the polypeptide (e.g., the promoter and/or enhancer) to form triple helical structures that prevent transcription of the gene in target cells. See generally Helene (1991) Anticancer Drug Des. 6(6):569-84; Helene (1992) Ann. N.Y. Acad. Sci. 660:27-36; and Maher (1992) Bioassays 14(12):807-15. "Expression" of a polypeptide, as used herein, refers individually and collectively to the processes of transcription of DNA to generate an RNA transcript and translation of an RNA to generate the polypeptide.

In various embodiments, the nucleic acid molecules of the invention can be modified at the base moiety, sugar moiety, or phosphate backbone to improve, e.g., the stability, hybridization, or solubility of the molecule. For example, the deoxyribose phosphate backbone of the nucleic acids can be modified to generate peptide nucleic acids (see Hyrup et al. (1996) Bioorganic & Medicinal Chemistry 4(1): 5-23). As used herein, the terms "peptide nucleic acids" or "PNAs" refer to nucleic acid mimics, e.g., DNA mimics, in which the deoxyribose phosphate backbone is replaced by a pseudopeptide backbone and only the four natural nucleobases are retained. The neutral backbone of PNAs has been shown to allow specific hybridization with DNA and RNA under conditions of low ionic strength. Synthesis of PNA oligomers can be performed using standard solid phase peptide synthesis protocols such as those described in Hyrup et al. (1996), supra; Perry-O'Keefe et al. (1996) Proc. Natl. Acad. Sci. USA 93: 14670-675.

PNAs can be used in therapeutic and diagnostic applications. For example, PNAs can be used as antisense or antigene agents for sequence-specific modulation of gene expression by, e.g., inducing arrest of transcription or translation or by inhibiting replication. PNAs can also be used, e.g., in the analysis of single base pair mutations in a gene by, e.g., PNA directed PCR clamping; as artificial restriction enzymes when used in combination with other enzymes, e.g., S1 nucleases (Hyrup (1996), supra; or as probes or primers for DNA sequence and hybridization (Hyrup (1996), supra; Perry-O'Keefe et al. (1996) Proc. Natl. Acad. Sci. USA 93: 14670-675).

In another embodiment, PNAs can be modified, e.g., to enhance their stability or cellular uptake, by attaching lipophilic or other helper groups to PNA, by formation of PNA-DNA chimeras, or by use of liposomes or other techniques of drug delivery known in the art. For example, PNA-DNA chimeras can be generated which can combine the advantageous properties of PNA and DNA. Such chimeras allow DNA recognition enzymes, e.g., RNase H and DNA polymerases, to interact with the DNA portion while the PNA portion providbs high binding affinity and specificity. PNA-DNA chimeras can be linked using linkers of appropriate lengths selected in terms of base stacking, number of bonds between the nucleobases, and orientation (Hyrup (1996), supra). The synthesis of PNA-DNA chimeras can be performed as described in Hyrup (1996), supra, and Finn et al. (1996) Nucleic Acids Res. 24(17):3357-63. For example, a DNA chain can be synthesized on a solid support using standard phosphoramidite coupling chemistry and modified nucleoside analogs. Compounds such as 5'-(4-methoxytrityl) amino-5'-deoxy-thymidine phosphoramidite can be used as a link between the PNA and the 5' end of DNA (Mag et al. (1989) Nucleic Acids Res. 17:5973-88). PNA monomers are then coupled in a step-wise manner to produce a chimeric molecule with a 5' PNA segment and a 3' DNA segment (Finn et al. (1996) Nucleic Acids Res. 24(17):3357-63). Alternatively, chimeric molecules can be synthesized with a 5' DNA segment and a 3' PNA segment (Peterser et al. (1975) Bioorganic Med. Chem. Lett. 5:1119-11124).

In other embodiments, the oligonucleotide can include other appended groups such as peptides (e.g., for targeting host cell receptors in vivo), or agents facilitating transport across the cell membrane (see, e.g., Letsinger et al. (1989) Proc. Natl. Acad. Sci. USA 86:6553-6556; Lemaitre et al. (1987) Proc. Natl. Acad. Sci. USA 84:648-652; PCT Publication No. WO 88/09810) or the blood-brain barrier (see, e.g., PCT Publication No. WO 89/10134). In addition, oligonucleotides can be modified with hybridization-triggered cleavage agents (see, e.g., Krol et al. (1988) Bio/Techniques 6:958-976) or intercalating agents (see, e.g., Zon (1988) Pharm. Res. 5:539-549). To this end, the oligonucleotide can be conjugated with another molecule, e.g., a peptide, hybridization triggered cross-linking agent, transport agent, hybridization-triggered cleavage agent, etc.

II. Isolated Proteins and Antibodies

One aspect of the invention pertains to isolated proteins, and biologically active portions thereof, as well as polypeptide fragments suitable for use as immunogens to generate antibodies directed against a polypeptide of the invention. In one embodiment, the native polypeptide is isolated from cells or tissue sources by an appropriate purification scheme using standard protein purification techniques. In another embodiment, polypeptides of the invention are produced by recombinant DNA techniques. As an alternative to recombinant expression, a polypeptide of the invention can be synthesized chemically using standard peptide synthesis techniques.

An "isolated" or "purified" protein or biologically active portion thereof is substantially free of cellular material or other contaminating proteins from the cell or tissue source from which the protein is derived, or substantially free of chemical precursors or other chemicals, when chemically synthesized. The language "substantially free of cellular material" includes preparations of protein in which the protein is separated from cellular components of the cells from which it is isolated or recombinantly produced. Thus, protein that is substantially free of cellular material includes preparations of protein having less than about 30%, 20%, 10%, or 5% (by dry weight) of heterologous protein (also referred to herein as a "contaminating protein"). When the protein or biologically active portion thereof is recombinantly produced, it is also preferably substantially free of culture medium, i.e., culture medium represents less than about 20%, 10%, or 5% of the volume of the protein preparation. When the protein is produced by chemical synthesis, it is preferably substantially free of chemical precursors or other chemicals, i.e., it is separated from chemical precursors or other chemicals which are involved in the synthesis of the protein. Accordingly such preparations of the protein have less than about 30%, 20%, 10%, 5% (by dry weight) of chemical precursors or compounds other than the polypeptide of interest.

Biologically active portions of a polypeptide of the invention include polypeptide regions having an amino acid sequence sufficiently identical to or derived from the amino acid sequence of the protein (e.g., the amino acid sequence shown in any of SEQ ID NOs: 3-8, 33, 35, 38, 53-60, 73-78, 83-85, 93-95, 98-100, 103-105, 108-110, 113-115, 123-131, 143-145, 153-160, 163, 173-175, 183-185, 193-198, 203-214, 216, 223-236, 243-252, 253, 273-278, 281-302, 305-307, 310-315, 326-328, 331-333, 353-358, 363-368, 373-378, 381-386, 389-394, 405-414, 417-422, 425-436, and 439, or the amino acid sequence encoded by the nucleotide sequence of any of the clones deposited as ATCC® Accession numbers 207184, 207219, 207220, 207221, 207228, 207230, PTA-147, PTA-150, PTA-151, PTA-295, PTA-424, PTA-438, PTA-455, PTA-817, PTA-1156, and PTA-1764), which include fewer amino acids than the full length protein, and exhibit at least one activity of the corresponding full-length protein. Typically, biologically active portions comprise a domain or motif with at least one activity of the corresponding protein. A biologically active portion of a protein of the invention can be a polypeptide which is, for example, 10, 25, 50, 100 or more amino acids in length. Moreover, other biologically active portions, in which other regions of the protein are deleted, can be prepared by recombinant techniques and evaluated for one or more of the functional activities of the native form of a polypeptide of the invention.

Examples of polypeptides have the amino acid sequence of any of SEQ ID NOs: 3-8, 33, 35, 38, 53-60, 73-78, 83-85, 93-95, 98-100, 103-105, 108-110, 113-115, 123-131, 143-145, 153-160, 163, 173-175, 183-185, 193-198, 203-214, 216, 223-236, 243-252, 253, 273-278, 281-302, 305-307, 310-315, 326-328, 331-333, 353-358, 363-368, 373-378, 381-386, 389-394, 405-414, 417-422, 425-436, and 439 or the amino acid sequence encoded by the nucleotide sequence of any of the clones deposited as ATCC® Accession numbers 207184, 207219, 207220, 207221, 207228, 207230, PTA-147, PTA-150, PTA-151, PTA-295, PTA-424, PTA-438, PTA-455, PTA-817, PTA-1156, and PTA-1764. Other useful proteins are substantially identical (e.g., at least about 40%, preferably 50%, 60%, 70%, 80%, 90%, 95%, or 99%) to any of SEQ ID NOs: 3-8, 33, 35, 38, 53-60, 73-78, 83-85, 93-95, 98-100, 103-105, 108-110, 113-115, 123-131, 143-145, 153-160,163,173-175, 183-185, 193-198,203-214, 216, 223-236, 243-252, 253, 273-278, 281-302, 305-307, 310-315, 326-328, 331-333, 353-358, 363-368, 373-378, 381-386, 389-394, 405-414, 417-422, 425-436, and 439 or the amino acid sequence encoded by the nucleotide sequence of any of the clones deposited as ATCC® Accession numbers 207184, 207219, 207220, 207221, 207228, 207230, PTA-147, PTA-150, PTA-151, PTA-295, PTA-424, PTA-438, PTA-455, PTA-817, PTA-1156, and PTA-1764 and retain the functional activity of the protein of the corresponding naturally-occurring protein. Such proteins can differ in amino acid sequence owing, for example, to natural allelic variation or mutagenesis.

The invention also provides chimeric or fusion proteins. As used herein, a "chimeric protein" or "fusion protein" comprises all or part (preferably biologically active) of a polypeptide of the invention operably linked with a heterologous polypeptide (i.e., a polypeptide other than the same polypeptide of the invention). Within the fusion protein, the term "operably linked" is intended to indicate that the polypeptide of the invention and the heterologous polypeptide are fused in-frame with each other. The heterologous polypeptide can be fused with the amino-terminus or the carboxyl-terminus of the polypeptide of the invention.

One useful fusion protein is a GST fusion protein in which the polypeptide of the invention is fused with the carboxyl terminus of GST sequences. Such fusion proteins can facilitate purification of a recombinant polypeptide of the invention.

In another embodiment, the fusion protein contains a heterologous signal sequence at its amino terminus. For example, the native signal sequence of a polypeptide of the invention can be removed and replaced with a signal sequence from another protein. For example, the gp67 secretory sequence of the baculovirus envelope protein can be used as a heterologous signal sequence (Current Protocols in Molecular Biology, Ausubel et al., eds., John Wiley & Sons, 1992). Other examples of eukaryotic heterologous signal sequences include the secretory sequences of melittin and human placental alkaline phosphatase (Stratagene; La Jolla, Calif.). In yet another example, useful prokaryotic heterologous signal sequences include the phoA secretory signal (Sambrook et al., supra) and the protein A secretory signal (Pharmacia Biotech; Piscataway, N.J.).

In yet another embodiment, the fusion protein is an immunoglobulin fusion protein in which all or part of a polypeptide of the invention is fused with sequences derived from a member of the immunoglobulin protein family. The immunoglobulin fusion proteins of the invention can be incorporated into pharmaceutical compositions and administered to a subject to inhibit an interaction between a ligand (soluble or membrane-bound) and a protein on the surface of a cell (receptor), to thereby suppress signal transduction in vivo. The immunoglobulin fusion protein can be used to affect the bioavailability of a cognate ligand of a polypeptide of the invention. Inhibition of ligand/receptor interaction can be useful therapeutically, both for treating proliferative and differentiative disorders and for modulating (e.g., promoting or inhibiting) cell survival. Moreover, the imrmunoglobulin fusion proteins of the invention can be used as immunogens to produce antibodies directed against a polypeptide of the invention in a subject, to purify ligands and in screening assays to identify molecules which inhibit the interaction of receptors with ligands. The immunoglobulin fusion protein can, for example, comprise a portion of a polypeptide of the invention fused with the amino-terminus or the carboxyl-terminus of an immunoglobulin constant region, as disclosed in U.S. Pat. No. 5,714,147, U.S. Pat. No. 5,116,964, U.S. Pat. No. 5,514, 582, and U.S. Pat. No. 5,455,165.

Chimeric and fusion proteins of the invention can be produced by standard recombinant DNA techniques. In another embodiment, the fusion gene can be synthesized by conventional techniques including automated DNA synthesizers. Alternatively, PCR amplification of gene fragments can be performed using anchor primers which give rise to complementary overhangs between two consecutive gene fragments and which can subsequently be annealed and re-amplified to generate a chimeric gene sequence (see, e.g., Ausubel et al., supra). Moreover, many expression vectors are commercially available that already encode a fusion moiety (e.g., a GST polypeptide). A nucleic acid encoding a polypeptide of the invention can be cloned into such an expression vector such that the fusion moiety is linked in-frame to the polypeptide of the invention.

A signal sequence of a polypeptide of the invention (e.g., the signal sequence in any of SEQ ID NOs: 3, 33, 53, 73, 83, 93, 98, 103, 108, 113, 123, 143, 153, 163, 173, 183, 193, 203, 216, 223, 243, 253, 273, 281, 305, 310, 326, 331, 353, 363, 381, 389, 405, 417, 425, and 439) can be used to facilitate secretion and isolation of the secreted protein or another protein of interest. Signal sequences are typically characterized by a core of hydrophobic amino acids which are generally cleaved from the mature protein during secretion in one or more cleavage events. Such signal peptides contain processing sites that allow cleavage of the signal sequence from the mature proteins as they pass through the secretory pathway. Thus, the invention pertains to the described polypeptides having a signal sequence, as well as to the signal sequence itself and to the polypeptide in the absence of the signal sequence (i.e., the cleavage products). In one embodiment, a nucleic acid sequence encoding a signal sequence of the invention can be operably linked in an expression vector with a protein of interest, such as a protein which is ordinarily not secreted or is otherwise difficult to isolate. The signal sequence directs secretion of the protein, such as from a eukaryotic host into which the expression vector is transformed, and the signal sequence is subsequently or concurrently cleaved. The protein can then be readily purified from the extracellular medium by art recognized methods. Alternatively, the signal sequence can be linked with the protein of interest using a sequence which facilitates purification, such as with a GST domain.

In another embodiment, the signal sequences of the present invention can be used to identify regulatory sequences, e.g., promoters, enhancers, repressors. Since signal sequences are the most amino-terminal sequences of a peptide, the nucleic acids which flank the signal sequence on its amino-terminal side are likely regulatory sequences which affect transcription. Thus, a nucleotide sequence which encodes all or a portion of a signal sequence can be used as a probe to identify and isolate signal sequences and their flanking regions, and these flanking regions can be studied to identify regulatory elements therein.

The present invention also pertains to variants of the polypeptides of the invention. Such variants have an altered amino acid sequence which can function as either agonists (mimetics) or as antagonists. Variants can be generated by mutagenesis, e.g., discrete point mutation or truncation. An agonist can retain substantially the same, or a subset, of the biological activities of the naturally occurring form of the protein. An antagonist of a protein can inhibit one or more of the activities of the naturally occurring form of the protein by, for example, competitively binding with a downstream or upstream member of a cellular signaling cascade which includes the protein of interest. Thus, specific biological effects can be elicited by treatment with a variant of limited function. Treatment of a subject with a variant having a subset of the biological activities of the naturally occurring form of the protein can have fewer side effects in a subject, relative to treatment with the naturally occurring form of the protein.

Variants of a protein of the invention which function as either agonists (e.g., mimetics) or as antagonists can be identified by screening combinatorial libraries of mutants, e.g., truncation mutants, of the protein of the invention for agonist or antagonist activity. In one embodiment, a variegated library of variants is generated by combinatorial mutagenesis at the nucleic acid level and is encoded by a variegated gene library. A variegated library of variants can be produced by, for example, enzymatically ligating a mixture of synthetic oligonucleotides into gene sequences such that a degenerate set of potential protein sequences can be expressed as individual polypeptides, or alternatively, as a set of larger fusion proteins (e.g., for phage display). There are a variety of methods which can be used to produce libraries of potential variants of the polypeptides of the invention from a degenerate oligonucleotide sequence. Methods for synthesizing degenerate oligonucleotides are known in the art (see, e.g., Narang (1983) Tetrahedron 39:3; Itakura et al. (1984) Annu. Rev. Biochem. 53:323; Itakura et al. (1984) Science 198:1056; Ike et al. (1983) Nucleic Acid Res. 11:477).

In addition, libraries of fragments of the coding sequence of a polypeptide of the invention can be used to generate a variegated population of polypeptides for screening and subsequent selection of variants. For example, a library of coding sequence fragments can be generated by treating a double stranded PCR fragment of the coding sequence of interest with a nuclease under conditions wherein nicking occurs only about once per molecule, denaturing the double stranded DNA, re-naturing the DNA to form double stranded DNA which can include sense/antisense pairs from different nicked products, removing single stranded portions from reformed duplexes by treatment with S1 nuclease, and ligating the resulting fragment library into an expression vector. By this method, an expression library can be derived which encodes amino terminal and internal fragments of various sizes of the protein of interest.

Several techniques are known in the art for screening gene products of combinatorial libraries made by point mutations or truncation, and for screening cDNA libraries for gene products having a selected property. The most widely used techniques, which are amenable to high through-put analysis, for screening large gene libraries typically include cloning the gene library into replicable expression vectors, transforming appropriate cells with the resulting library of vectors, and expressing the combinatorial genes under conditions in which detection of a desired activity facilitates isolation of the vector encoding the gene whose product was detected. Recursive ensemble mutagenesis (REM), a technique which enhances the frequency of functional mutants in the libraries, can be used in combination with the screening assays to identify variants of a protein of the invention (Arkin and Yourvan (1992) Proc. Natl. Acad. Sci. USA 89:7811-7815; Delgrave et al. (1993) Protein Engineering 6(3):327-331).

An isolated polypeptide of the invention, or a fragment thereof, can be used as an immunogen to generate antibodies using standard techniques for polyclonal and monoclonal antibody preparation. The full-length polypeptide or protein can be used or, alternatively, the invention provides antigenic peptide fragments for use as immunogens. The antigenic peptide of a protein of the invention comprises at least 10 (preferably 12, 15, 20, or 30 or more) amino acid residues of the amino acid sequence of any of SEQ ID NOs: 3-8, 33, 35, 38, 53-60, 73-78, 83-85, 93-95, 98-100, 103-105, 108-110, 113-115, 123-131, 143-145, 153-160, 163, 173-175, 183-185, 193-198, 203-214, 216, 223-236, 243-252, 253, 273-278-, 281-302, 305-307, 310-315, 326-328, 331-333, 353-358, 363-368, 373-378, 381-386, 389-394, 405-414, 417-422, 425-436, and 439 or the amino acid sequence encoded by the nucleotide sequence of any of the clones deposited as ATCC® Accession numbers 207184, 207219, 207220, 207221, 207228, 207230, PTA-147, PTA-150, PTA-151, PTA-295, PTA-424, PTA-438, PTA-455, PTA-817, PTA-1156, and PTA-1764, and encompasses an epitope of the protein such that an antibody raised against the peptide forms a specific immune complex with the protein.

Examples of epitopes encompassed by the antigenic peptide are regions that are located on the surface of the protein, e.g., hydrophilic regions. FIGS. 1, 5, 7, 10A-10F, 12, 13, 18, 19, 20, 21, 27, 28, 29, 30, 36, 38, 40, 41, 44, 47, 48, 51, 56A-56B, 57, 62, 63, 67 and 69 are hydrophobicity plots of proteins of the invention. These or similar analyses can be used to identify hydrophilic regions.

An immunogen typically is used to prepare antibodies by immunizing a suitable (i.e., immunocompetent) subject such as a rabbit, goat, mouse, or other mammal or vertebrate. An appropriate immunogenic preparation-can contain, for example, recombinantly-expressed or chemically-synthesized polypeptide. The preparation can further include an adjuvant, such as Freund's complete or incomplete adjuvant, or a similar immunostimulatory agent.

Accordingly, another aspect of the invention pertains to antibodies directed against a polypeptide of the invention. The terms "antibody" and "antibody substance" as used interchangeably herein refer to immunoglobulin molecules and immunologically active portions of immunoglobulin molecules, i.e., molecules that contain an antigen binding site which specifically binds an antigen, such as a polypeptide of the invention. A molecule which specifically binds with a given polypeptide of the invention is a molecule which binds the polypeptide, but does not substantially bind other molecules in a sample, e.g., a biological sample, which naturally contains the polypeptide. Examples of immunologically active portions of immunoglobulin molecules include F(ab) and F(ab')$_2$ fragments which can be generated by treating the antibody with an enzyme such as pepsin. The invention provides polyclonal and monoclonal antibodies. The term "monoclonal antibody" or "monoclonal antibody composition", as used herein, refers to a population of antibody molecules that contain only one species of an antigen binding site capable of immunoreacting with a particular epitope.

Polyclonal antibodies can be prepared as described above by immunizing a suitable subject with a polypeptide of the invention as an immunogen. The antibody titer in the immunized subject can be monitored over time by standard techniques, such as with an enzyme linked immunosorbent assay (ELISA) using immobilized polypeptide. If desired, the antibody molecules can be harvested or isolated from the subject (e.g., from the blood or serum of the subject) and further purified by well-known techniques, such as protein A chromatography to obtain the IgG fraction. At an appropriate time after immunization, e.g., when the specific antibody titers are highest, antibody-producing cells can be obtained from the subject and used to prepare monoclonal antibodies by standard techniques, such as the hybridoma technique originally described by Kohler and Milstein (1975) Nature 256:495-497, the human B cell hybridoma technique (Kozbor et al. (1983) Immunol. Today 4:72), the EBV-hybridoma technique (Cole et al. (1985), Monoclonal Antibodies and Cancer Therapy, Alan R. Liss, Inc., pp. 77-96) or trioma techniques. The technology for producing hybridomas is well known (see generally Current Protocols in Immunology (1994) Coligan et al. (Eds.) John Wiley & Sons, Inc., New York, N.Y.). Hybridoma cells producing a monoclonal antibody of the invention are detected by screening the hybridoma culture supernatants for antibodies that bind the polypeptide of interest, e.g., using a standard ELISA assay.

Alternative to preparing monoclonal antibody-secreting hybridomas, a monoclonal antibody directed against a polypeptide of the invention can be identified and isolated by screening a recombinant combinatorial immunoglobulin library (e.g., an antibody phage display library) with the polypeptide of interest. Kits for generating and screening phage display libraries are commercially available (e.g., the Pharmacia Recombinant Phage Antibody System, Catalog No. 27-9400-01; and the Stratagene SurfZAP Phage Display Kit, Catalog No. 240612). Additionally, examples of methods and reagents particularly amenable for use in generating and screening antibody display library can be found in, for example, U.S. Pat. No. 5,223,409; PCT Publication No. WO 92/18619; PCT Publication No. WO 91/17271; PCT Publication No. WO 92/20791; PCT Publication No. WO 92/15679; PCT Publication No. WO 93/01288; PCT Publication No. WO 92/01047; PCT Publication No. WO 92/09690; PCT Publication No. WO 90/02809; Fuchs et al. (1991) Bio/Technology 9:1370-1372; Hay et al. (1992) Hum. Antibod. Hybridomas 3:81-85; Huse et al. (1989) Science 246:1275-1281; Griffiths et al. (1993) EMBO J. 12:725-734.

Recombinant antibodies, such as chimeric and humanized monoclonal antibodies, comprising both human and non-human portions, which can be made using standard recombinant DNA techniques, are within the scope of the invention. Such chimeric and humanized monoclonal antibodies can be produced by recombinant DNA techniques known in the art, for example using methods described in PCT Publication No. WO 87/02671; European Patent Application 184,187; European Patent Application 171,496; European Patent Application 173,494; PCT Publication No. WO 86/01533; U.S. Pat. No. 4,816,567; European Patent Application 125,023; Better et al. (1988) Science 240:1041-1043; Liu et al. (1987) Proc. Natl. Acad. Sci. USA 84:3439-3443; Liu et al. (1987) J. Immunol. 139:3521-3526; Sun et al. (1987) Proc. Natl. Acad. Sci. USA 84:214-218; Nishimura et al. (1987) Cancer Res. 47:999-1005; Wood et al. (1985) Nature 314:446-449; and Shaw et al. (1988) J. Natl. Cancer Inst. 80:1553-1559); Morrison (1985) Science 229:1202-1207; Oi et al. (1986) Bio/Techniques 4:214; U.S. Pat. No. 5,225,539; Jones et al. (1986) Nature 321:552-525; Verhoeyan et al. (1988) Science 239:1534; and Beidler et al. (1988) J. Immunol. 141:4053-4060.

Completely human antibodies are particularly desirable for therapeutic treatment of human patients. Such antibodies can be produced using transgenic mice which are incapable of expressing endogenous immunoglobulin heavy and light chains genes, but which can express human heavy and light chain genes. The transgenic mice are immunized in the normal fashion with a selected antigen, e.g., all or a portion of a polypeptide of the invention. Monoclonal antibodies directed against the antigen can be obtained using conventional hybridoma technology. The human immunoglobulin transgenes harbored by the transgenic mice rearrange during B cell differentiation, and subsequently undergo class switching and somatic mutation. Thus, using such a technique, it is possible to produce therapeutically useful IgG, IgA, and IgE antibodies. For an overview of this technology for producing human antibodies, see Lonberg and Huszar (1995, Int. Rev. Immunol. 13:65-93). For a detailed discussion of this technology for producing human antibodies and human monoclonal antibodies and protocols for producing such antibodies, see, e.g., U.S. Pat. Nos. 5,625,126; 5,633,425; 5,569,825; 5,661,016; and 5,545,806. In addition, companies such as Abgenix, Inc. (Freemont, Calif.), can be engaged to provide human antibodies directed against a selected antigen using technology similar to that described above.

Completely human antibodies which recognize a selected epitope can be generated using a technique referred to as "guided selection." In this approach a selected non-human monoclonal antibody, e.g., a murine antibody, is used to guide the selection of a completely human antibody recognizing the same epitope (Jespers et al. (1994) Bio/technology 12:899-903).

An antibody directed against a polypeptide of the invention (e.g., monoclonal antibody) can be used to isolate the polypeptide by standard techniques, such as affinity chromatography or immunoprecipitation. Moreover, such an antibody can be used to detect the protein (e.g., in a cellular lysate or cell supernatant) in order to evaluate the abundance and pattern of expression of the polypeptide. The antibodies can also be used diagnostically to monitor protein levels in tissue as part of a clinical testing procedure, e.g., to, for example, determine the efficacy of a given treatment regimen. Detection can be facilitated by coupling the antibody to a detectable substance. Examples of detectable substances include various enzymes, prosthetic groups, fluorescent materials, luminescent materials, bioluminescent materials, and radioactive materials. Examples of suitable enzymes include horseradish peroxidase, alkaline phosphatase, β-galactosidase, or acetylcholinesterase; examples of suitable prosthetic group complexes include streptavidin/biotin and avidin/biotin; examples of suitable fluorescent materials include umbelliferone, fluorescein, fluorescein isothiocyanate, rhodamine, dichlorotriazinylamine fluorescein, dansyl chloride or phycoerythrin; an example of a luminescent material includes luminol; examples of bioluminescent materials include luciferase, luciferin, and aequorin, and examples of suitable radioactive material include $^{125}I$, $^{131}I$, $^{35}S$ or $^{3}H$.

An antibody (or fragment thereof) can be conjugated to a therapeutic moiety such as a cytotoxin, a therapeutic agent, or a radioactive agent (e.g., a radioactive metal ion). Cytotoxins and cytotoxic agents include any agent that is detrimental to cells. Examples of such agents include taxol, cytochalasin B, gramicidin D, ethidium bromide, emetine, mitomycin, etoposide, tenoposide, vincristine, vinblastine, colchicin, doxorubicin, daunorubicin, dihydroxy anthracin dione, mitoxantrone, mithramycin, actinomycin D, 1-dehydrotestosterone, glucocorticoids, procaine, tetracaine, lidocaine, propranolol, and puromycin and analogs or homologs thereof. Therapeutic agents include, but are not limited to, antimetabolites (e.g., methotrexate, 6-mercaptopurine, 6-thioguanine, cytarabine, and 5-fluorouracil decarbazine), alkylating agents (e.g., mechlorethamine, thioepa chlorambucil, melphalan, carmustine (BSNU) and lomustine (CCNU), cyclothosphamide, busulfan, dibromomannitol, streptozotocin, mitomycin C, and cis-dichlorodiamine platinum (II) (DDP) cisplatin), anthracyclines (e.g., daunorubicin {formerly designated daunomycin} and doxorubicin), antibiotics (e.g., dactinomycin {formerly designated actinomycin}, bleomycin, mithramycin, and anthramycin), and antimitotic agents (e.g., vincristine and vinblastine).

Conjugated antibodies of the invention can be used for modifying a given biological response, the drug moiety not being limited to classical chemical therapeutic agents. For example, the drug moiety can be a protein or polypeptide possessing a desired biological activity. Such proteins include, for example, toxins such as abrin, ricin A, Pseudomonas exotoxin, or diphtheria toxin; proteins such as tumor necrosis factor, alpha-interferon, beta-interferon, nerve growth factor, platelet derived growth factor, tissue plasminogen activator; and biological response modifiers such as lymphokines, interleukin-1, interleukin-2, interleukin-6, granulocyte macrophage colony stimulating factor, granulocyte colony stimulating factor, or other growth factors.

Techniques for conjugating a therapeutic moiety to an antibody are well known (see, e.g., Arnon et al., 1985, "Monoclonal Antibodies For Immunotargeting Of Drugs In Cancer Therapy", in Monoclonal Antibodies And Cancer Therapy, Reisfeld et al., Eds., Alan R. Liss, Inc. pp. 243-256; Hellstrom et al., 1987, "Antibodies For Drug Delivery", in Controlled Drug Delivery, 2nd ed., Robinson et al., Eds., Marcel Dekker, Inc., pp. 623-653; Thorpe, 1985, "Antibody Carriers Of Cytotoxic Agents In Cancer Therapy: A Review", in Monoclonal Antibodies '84: Biological And Clinical Applications, Pinchera et al., Eds., pp. 475-506; "Analysis, Results, And Future Prospective Of The Therapeutic Use Of Radiolabeled Antibody In Cancer Therapy", in Monoclonal Antibodies For Cancer Detection And Therapy, Baldwin et al., Eds., Academic Press, pp. 303-316, 1985; and Thorpe et al., 1982, Immunol. Rev., 62:119-158). Alternatively, an antibody can be conjugated to a second antibody to form an antibody heteroconjugate as described by Segal in U.S. Pat. No. 4,676,980.

III. Recombinant Expression Vectors and Host Cells

Another aspect of the invention pertains to vectors, including expression vectors, containing a nucleic acid encoding a polypeptide of the invention (or a portion thereof). As used herein, the term "vector" refers to a nucleic acid molecule capable of transporting another nucleic acid to which it has been linked. One type of vector is a "plasmid", which refers to a circular double stranded DNA loop into which additional DNA segments can be ligated. Another type of vector is a viral vector, wherein additional DNA segments can be ligated into the viral genome. Certain vectors are capable of autonomous replication in a host cell into which they are introduced (e.g., bacterial vectors having a bacterial origin of replication and episomal mammalian vectors). Other vectors (e.g., non-episomal mammalian vectors) are integrated into the genome of a host cell upon introduction into the host cell, and thereby are replicated along with the host genome. Moreover, certain vectors, designated expression vectors, are capable of directing expression of genes with which they are operably linked.

In general, expression vectors of utility in recombinant DNA techniques are often in the form of plasmids (vectors). However, the invention is intended to include such other forms of expression vectors, such as viral vectors (e.g., replication defective retroviruses, adenoviruses and adeno-associated viruses), which serve equivalent functions.

The recombinant expression vectors of the invention comprise a nucleic acid of the invention in a form suitable for expression of the nucleic acid in a host cell. This means that the recombinant expression vectors include one or more regulatory sequences, selected on the basis of the host cells to be used for expression, which is operably linked with the nucleic acid sequence to be expressed. Within a recombinant expression vector, "operably linked" is intended to mean that the nucleotide sequence of interest is linked with the regulatory sequence(s) in a manner which allows expression of the nucleotide sequence (e.g., in an in vitro transcription/translation system or in a host cell when the vector is introduced into the host cell). The term "regulatory sequence" is intended to include promoters, enhancers and other expression control elements (e.g., polyadenylation signals). Such regulatory sequences are described, for example, in Goeddel, Gene Expression Technology: Methods in Enzymology 185, Academic Press, San Diego, Calif. (1990). Regulatory sequences include those which direct constitutive expression of a nucleotide sequence in many types of host cell and those which direct expression of the nucleotide sequence only in certain host cells (e.g., tissue-specific regulatory sequences). It will be appreciated by those skilled in the art that the design of the expression vector can depend on such factors as the choice of the host cell to be transformed, and the level of expression of protein desired. The expression vectors of the invention can be introduced into host cells to thereby produce proteins or peptides, including fusion proteins or peptides, encoded by nucleic acids as described herein.

The recombinant expression vectors of the invention can be designed for expression of a polypeptide of the invention in prokaryotic (e.g., *E. coli*) or eukaryotic cells (e.g., insect cells (using baculovirus expression vectors), yeast cells or mammalian cells). Suitable host cells are discussed further in Goeddel, supra. Alternatively, the recombinant expression vector can be transcribed and translated in vitro, for example using T7 promoter regulatory sequences and T7 polymerase.

Expression of proteins in prokaryotes is most often carried out in *E. coli* with vectors containing constitutive or inducible promoters directing the expression of either fusion or non-fusion proteins. Fusion vectors add a number of amino acids to a protein encoded therein, usually to the amino terminus of the recombinant protein. Such fusion vectors typically serve three purposes: 1) to increase expression of recombinant protein; 2) to increase the solubility of the recombinant protein; and 3) to aid in the purification of the recombinant protein by acting as a ligand in affinity purification. Often, in fusion expression vectors, a proteolytic cleavage site is introduced at the junction of the fusion moiety and the recombinant protein to enable separation of the recombinant protein from the fusion moiety subsequent to purification of the fusion protein. Such enzymes, and their cognate recognition sequences, include Factor Xa, thrombin and enterokinase. Typical fusion expression vectors include pGEX (Pharmacia Biotech Inc; Smith and Johnson (1988) Gene 67:31-40), pMAL (New England Biolabs, Beverly, Mass.) and pRIT5 (Pharmacia, Piscataway, N.J.) which fuse glutathione S-transferase (GST), maltose E binding protein, or protein A, respectively, to the target recombinant protein.

Examples of suitable inducible non-fusion *E. coli* expression vectors include pTrc (Amann et al., (1988) Gene 69:301-

315) and pET 11d (Studier et al., Gene Expression Technology: Methods in Enzymology 185, Academic Press, San Diego, Calif. (1990) 60-89). Target gene expression from the pTrc vector relies on host RNA polymerase transcription from a hybrid trp-lac fusion promoter. Target gene expression from the pET 11d vector relies on transcription from a T7 gn10-lac fusion promoter mediated by a co-expressed viral RNA polymerase (T7 gn1). This viral polymerase is supplied by host strains BL21(DE3) or HMS174(DE3) from a resident λ prophage harboring a T7 gn1 gene under the transcriptional control of the lacUV 5 promoter.

One strategy to maximize recombinant protein expression in *E. coli* is to express the protein in a host bacteria having an impaired capacity to proteolytically cleave the recombinant protein (Gottesman, Gene Expression Technology: Methods in Enzymology 185, Academic Press, San Diego, Calif. (1990) 119-128). Another strategy is to alter the nucleic acid sequence of the nucleic acid to be inserted into an expression vector such that the individual codons for each amino acid are those preferentially used in *E. coli* (Wada et al. (1992) Nucleic Acids Res. 20:2111-2118). Such alteration of nucleic acid sequences of the invention can be performed by standard DNA synthesis techniques.

In another embodiment, the expression vector is a yeast expression vector. Examples of vectors for expression in yeast *S. cerevisiae* include pYepSec1 (Baldari et al. (1987) EMBO J. 6:229-234), pMFa (Kurjan and Herskowitz, (1982) Cell 30:933-943), pJRY88 (Schultz et al. (1987) Gene 54:113-123), pYES2 (Invitrogen Corporation, San Diego, Calif.), and pPicZ (Invitrogen Corp, San Diego, Calif.).

Alternatively, the expression vector is a baculovirus expression vector. Baculovirus vectors available for expression of proteins in cultured insect cells (e.g., Sf 9 cells) include the pAc series (Smith et al. (1983) Mol. Cell Biol. 3:2156-2165) and the pVL series (Lucklow and Summers (1989) Virology 170:31-39).

In yet another embodiment, a nucleic acid of the invention is expressed in mammalian cells using a mammalian expression vector. Examples of mammalian expression vectors include pCDM8 (Seed (1987) Nature 329:840) and pMT2PC (Kaufman et al. (1987) EMBO J. 6:187-195). When used in mammalian cells, the expression vector's control functions are often provided by viral regulatory elements. For example, commonly used promoters are derived from polyoma, Adenovirus 2, cytomegalovirus and Simian Virus 40. For other suitable expression systems for both prokaryotic and eukaryotic cells see chapters 16 and 17 of Sambrook et al., supra.

In another embodiment, the recombinant mammalian expression vector is capable of directing expression of the nucleic acid preferentially in a particular cell type (e.g., tissue-specific regulatory elements are used to express the nucleic acid). Tissue-specific regulatory elements are known in the art. Non-limiting examples of suitable tissue-specific promoters include the albumin promoter (liver-specific; Pinkert et al. (1987) Genes Dev. 1:268-277), lymphoid-specific promoters (Calame and Eaton (1988) Adv. Immunol. 43:235-275), in particular promoters of T cell receptors (Winoto and Baltimore (1989) EMBO J. 8:729-733) and immunoglobulins (Banerji et al. (1983) Cell 33:729-740; Queen and Baltimore (1983) Cell 33:741-748), neuron-specific promoters (e.g., the neurofilament promoter; Byrne and Ruddle (1989) Proc. Natl. Acad. Sci. USA 86:5473-5477), pancreas-specific promoters (Edlund et al. (1985) Science 230:912-916), and mammary gland-specific promoters (e.g., milk whey promoter; U.S. Pat. No. 4,873,316 and European Application Publication No. 264,166). Developmentally-regulated promoters are also encompassed, for example the murine hox promoters (Kessel and Gruss (1990) Science 249:374-379) and the α-fetoprotein promoter (Campes and Tilghman (1989) Genes Dev. 3:537-546).

The invention further provides a recombinant expression vector comprising a DNA molecule of the invention cloned into the expression vector in an antisense orientation. That is, the DNA molecule is operably linked with a regulatory sequence in a manner which allows for expression (by transcription of the DNA molecule) of an RNA molecule which is antisense, relative to the mRNA encoding a polypeptide of the invention. Regulatory sequences operably linked with a nucleic acid cloned in the antisense orientation can be selected which direct continuous expression of the antisense RNA molecule in a variety of cell types, for instance viral promoters and/or enhancers, or regulatory sequences can be selected which direct constitutive, tissue specific, or cell type specific expression of antisense RNA. The antisense expression vector can be in the form of a recombinant plasmid, phagemid, or attenuated virus in which antisense nucleic acids are produced under the control of a high efficiency regulatory region, the activity of which can be determined by the cell type into which the vector is introduced. For a discussion of the regulation of gene expression using antisense genes see Weintraub et al. (Reviews—Trends in Genetics, Vol. 1(1) 1986).

Another aspect of the invention pertains to host cells into which a recombinant expression vector of the invention has been introduced. The terms "host cell" and "recombinant host cell" are used interchangeably herein. It is understood that such terms refer not only to the particular subject cell but to the progeny or potential progeny of such a cell. Because certain modifications can occur in succeeding generations due to either mutation or environmental influences, such progeny may not, in fact, be identical to the parent cell, but are still included within the scope of the term as used herein.

A host cell can be any prokaryotic (e.g., *E. coli*) or eukaryotic cell (e.g., insect cells, yeast or mammalian cells).

Vector DNA can be introduced into prokaryotic or eukaryotic cells via conventional transformation or transfection techniques. As used herein, the terms "transformation" and "transfection" are intended to refer to a variety of art-recognized techniques for introducing foreign nucleic acid into a host cell, including calcium phosphate or calcium chloride co-precipitation, DEAE-dextran-mediated transfection, lipofection, and electroporation.

Suitable methods for transforming or transfecting host cells can be found in Sambrook, et al. (supra), and other laboratory manuals.

For stable transfection of mammalian cells, it is known that, depending upon the expression vector and transfection technique used, only a small fraction of cells integrate the foreign DNA into their genome. In order to identify and select these integrants, a gene that encodes a selectable marker (e.g., for resistance to antibiotics) can be introduced into the host cells along with the gene of interest. Examples of selectable markers include those which confer resistance to drugs, such as G418, hygromycin and methotrexate. Cells stably transfected with the introduced nucleic acid can be identified by drug selection (e.g., cells that have incorporated the selectable marker gene survive, while other cells die).

A host cell of the invention, such as a prokaryotic or eukaryotic host cell in culture, can be used to produce a polypeptide of the invention. Accordingly, the invention further provides methods for producing a polypeptide of the invention using the host cells of the invention. In one embodiment, the method comprises culturing the host cell of invention (into which a recombinant expression vector encoding a polypeptide of the invention has been introduced) in a suitable medium such that the polypeptide is produced. In another embodiment, the method further comprises isolating the polypeptide from the medium or the host cell.

The host cells of the invention can be used to produce non-human transgenic animals. For example, in one embodiment, a host cell of the invention is a fertilized oocyte or an embryonic stem cell into which a sequences encoding a polypeptide of the invention have been introduced. Such host cells can then be used to create non-human transgenic animals in which exogenous sequences encoding a polypeptide of the invention have been introduced into their genome or homologous recombinant animals in which endogenous encoding a polypeptide of the invention sequences have been altered. Such animals are useful for studying the function and/or activity of the polypeptide and for identifying and/or evaluating modulators of polypeptide activity. As used herein, a "transgenic animal" is a non-human animal, preferably a mammal, more preferably a rodent such as a rat or mouse, in which one or more of the cells of the animal includes a transgene. Other examples of transgenic animals include non-human primates, sheep, dogs, cows, goats, chickens, amphibians, etc. A transgene is exogenous DNA which is integrated into the genome of a cell from which a transgenic animal develops and which remains in the genome of the mature animal, thereby directing expression of an encoded gene product in one or more cell types or tissues of the transgenic animal. As used herein, an "homologous recombinant animal" is a non-human animal, preferably a mammal, more preferably a mouse, in which an endogenous gene has been altered by homologous recombination between the endogenous gene and an exogenous DNA molecule introduced into a cell of the animal, e.g., an embryonic cell of the animal, prior to development of the animal.

A transgenic animal of the invention can be created by introducing a nucleic acid encoding a polypeptide of the invention (or a homologue thereof) into the male pronuclei of a fertilized oocyte (e.g., by microinjection or retroviral infection) and allowing the oocyte to develop in a pseudopregnant female foster animal. Intronic sequences and polyadenylation signals can also be included in the transgene to increase the efficiency of expression of the transgene. A tissue-specific regulatory sequence(s) can be operably linked with the transgene to direct expression of a polypeptide of the invention to particular cells. Methods for generating transgenic animals via embryo manipulation and microinjection, particularly animals such as mice, have become conventional in the art and are described, for example, in U.S. Pat. Nos. 4,736,866 and 4,870,009, 4,873,191 and in Hogan, Manipulating the Mouse Embryo, (Cold Spring Harbor Laboratory Press, Cold Spring Harbor, N.Y., 1986). Similar methods are used for production of other transgenic animals. A transgenic founder animal can be identified based upon the presence of the transgene in its genomne and/or expression of mRNA encoding the transgene in tissues or cells of the animals. A transgenic founder animal can be used to breed additional animals carrying the transgene. Moreover, transgenic animals harboring the transgene can further be bred to other transgenic animals harboring other transgenes.

To create an homologous recombinant animal, a vector is prepared which contains at least a portion of a gene encoding a polypeptide of the invention into which a deletion, addition or substitution has been introduced to thereby alter, e.g., functionally disrupt, the gene. In one embodiment, the vector is designed such that, upon homologous recombination, the endogenous gene is functionally disrupted (i.e., no longer encodes a functional protein; also referred to as a "knock out" vector). Alternatively, the vector can be designed such that, upon homologous recombination, the endogenous gene is mutated or otherwise altered, but still encodes functional protein (e.g., the upstream regulatory region can be altered to thereby alter the expression of the endogenous protein). In the homologous recombination vector, the altered portion of the gene is flanked at its 5' and 3' ends by additional nucleic acid of the gene to allow for homologous recombination to occur between the exogenous gene carried by the vector and an endogenous gene in an embryonic stem cell. The additional flanking nucleic acid sequences are of sufficient length for successful homologous recombination with the endogenous gene. Typically, several kilobases of flanking DNA (both at the 5' and 3' ends) are included in the vector (see, e.g., Thomas and Capecchi (1987) Cell 51:503 for a description of homologous recombination vectors). The vector is introduced into an embryonic stem cell line (e.g., by electroporation) and cells in which the introduced gene has homologously recombined with the endogenous gene are selected (see, e.g., Li et al. (1992) Cell 69:915). The selected cells are then injected into a blastocyst of an animal (e.g., a mouse) to form aggregation chimeras (see, e.g., Bradley in Teratocarcinomas and Embryonic Stem Cells: A Practical Approach, Robertson, ed. (IRL, Oxford, 1987) pp. 113-152). A chimeric embryo can then be implanted into a suitable pseudopregnant female foster animal and the embryo brought to term. Progeny harboring the homologously recombined DNA in their germ cells can be used to breed animals in which all cells of the animal contain the homologously recombined DNA by germline transmission of the transgene. Methods for constructing homologous recombination vectors and homologous recombinant animals are described further in Bradley (1991) Current Opinion in Bio/Technology 2:823-829 and in PCT Publication Numbers WO 90/11354, WO 91/01140, WO 92/0968, and WO 93/04169.

In another embodiment, transgenic non-human animals can be produced which contain selected systems which allow for regulated expression of the transgene. One example of such a system is the cre/loxP recombinase system of bacteriophage P1. For a description of the cre/loxP recombinase system, see, e.g., Lakso et al. (1992) Proc. Natl. Acad. Sci. USA 89:6232-6236. Another example of a recombinase system is the FLP recombinase system of *Saccharomyces cerevisiae* (O'Gorman et al. (1991) Science 251:1351-1355. If a cre/loxP recombinase system is used to regulate expression of the transgene, animals containing transgenes encoding both the Cre recombinase and a selected protein are required. Such animals can be provided through the construction of "double" transgenic animals, e.g., by mating two transgenic animals, one containing a transgene encoding a selected protein and the other containing a transgene encoding a recombinase.

Clones of the non-human transgenic animals described herein can be produced according to the methods described in Wilmut et al. (1997) Nature 385:810-813 and PCT Publication Numbers WO 97/07668 and WO 97/07669.

IV. Pharmaceutical Compositions

The nucleic acid molecules, polypeptides, and antibodies (also referred to herein as "active compounds") of the invention can be incorporated into pharmaceutical compositions suitable for administration. Such compositions typically comprise the nucleic acid molecule, protein, or antibody and a pharmaceutically acceptable carrier. As used herein the language "pharmaceutically acceptable carrier" is intended to include any and all solvents, dispersion media, coatings, antibacterial and anti-fungal agents, isotonic and absorption delaying agents, and the like, compatible with pharmaceutical administration. The use of such media and agents for pharmaceutically active substances is well known in the art. Except insofar as any conventional media or agent is incompatible with the active compound, use thereof in the compositions is contemplated. Supplementary active compounds can also be incorporated into the compositions.

The invention includes methods for preparing pharmaceutical compositions for modulating the expression or activity of a polypeptide or nucleic acid of the invention. Such methods comprise formulating a pharmaceutically acceptable carrier with an agent which modulates expression or activity of a polypeptide or nucleic acid of the invention. Such compositions can further include additional active agents. Thus, the invention further includes methods for preparing a pharmaceutical composition by formulating a pharmaceutically acceptable carrier with an agent which modulates expression or activity of a polypeptide or nucleic acid of the invention and one or more additional active compounds.

The agent which modulates expression or activity can, for example, be a small molecule. For example, such small molecules include peptides, peptidomimetics, amino acids, amino acid analogs, polynucleotides, polynucleotide analogs, nucleotides, nucleotide analogs, organic or inorganic compounds (i.e., including heteroorganic and organometallic compounds) having a molecular weight less than about 10,000 grams per mole, organic or inorganic compounds having a molecular weight less than about 5,000 grams per mole, organic or inorganic compounds having a molecular weight less than about 1,000 grams per mole, organic or inorganic compounds having a molecular weight less than about 500 grams per mole, and salts, esters, and other pharmaceutically acceptable forms of such compounds.

It is understood that appropriate doses of small molecule agents and protein or polypeptide agents depends upon a number of factors within the ken of the ordinarily skilled physician, veterinarian, or researcher. The dose(s) of these agents will vary, for example, depending upon the identity, size, and condition of the subject or sample being treated, further depending upon the route by which the composition is to be administered, if applicable, and the effect which the practitioner desires the agent to have upon the nucleic acid or polypeptide of the invention. Examples of doses of a small molecule include milligram or microgram amounts per kilogram of subject or sample weight (e.g., about 1 microgram per kilogram to about 500 milligrams per kilogram, about 100 micrograms per kilogram to about 5 milligrams per kilogram, or about 1 microgram per kilogram to about 50 micrograms per kilogram). Examples of doses of a protein or polypeptide include gram, milligram or microgram amounts per kilogram of subject or sample weight (e.g., about 1 microgram per kilogram to about 5 grams per kilogram, about 100 micrograms per kilogram to about 500 milligrams per kilogram, or about 1 milligram per kilogram to about 50 milligrams per kilogram). For antibodies, examples of dosages are from about 0.1 milligram per kilogram to 100 milligrams per kilogram of body weight (generally 10 milligrams per kilogram to 20 milligrams per kilogram). If the antibody is to act in the brain, a dosage of 50 milligrams per kilogram to 100 milligrams per kilogram is usually appropriate. It is furthermore understood that appropriate doses of one of these agents depend upon the potency of the agent with respect to the expression or activity to be modulated. Such appropriate doses can be determined using the assays described herein. When one or more of these agents is to be administered to an animal (e.g., a human) in order to modulate expression or activity of a polypeptide or nucleic acid of the invention, a physician, veterinarian, or researcher can, for example, prescribe a relatively low dose at first, subsequently increasing the dose until an appropriate response is obtained. In addition, it is understood that the specific dose level for any particular animal subject will depend upon a variety of factors including the activity of the specific agent employed, the age, body weight, general health, gender, and diet of the subject, the time of administration, the route of administration, the rate of excretion, any drug combination, and the degree of expression or activity to be modulated.

A pharmaceutical composition of the invention is formulated to be compatible with its intended route of administration. Examples of routes of administration include patenteral, e.g., intravenous, intradermal, subcutaneous, oral (e.g., inhalation), transdermal (topical), transmucosal, and rectal administration. Solutions or suspensions used for parenteral, intradermal, or subcutaneous application can include the following components: a sterile diluent such as water for injection, saline solution, fixed oils, polyethylene glycols, glycerine, propylene glycol or other synthetic solvents; antibacterial agents such as benzyl alcohol or methyl parabens; antioxidants such as ascorbic acid or sodium bisulfite; chelating agents such as ethylenediamine-tetraacetic acid; buffers such as acetates, citrates or phosphates; and agents for the adjustment of tonicity such as sodium chloride or dextrose. pH can be adjusted using acids or bases, such as hydrochloric acid or sodium hydroxide. The parenteral preparation can be enclosed in ampules, disposable syringes or multiple dose vials made of glass or plastic.

Pharmaceutical compositions suitable for injectable use include sterile aqueous solutions (where water soluble) or dispersions and sterile powders for the extemporaneous preparation of sterile injectable solutions or dispersions. For intravenous administration, suitable carriers include physiological saline, bacteriostatic water, CREMOPHORT™ EL (BASF; Parsippany, N.J.) or phosphate buffered saline (PBS). The composition should be sterile and should be fluid to the extent that easy syringability exists. It should be stable under the conditions of manufacture and storage and should be preserved against the contaminating action of microorganisms such as bacteria and fungi. The carrier can be a solvent or dispersion medium containing, for example, water, ethanol, polyol (for example, glycerol, propylene glycol, and liquid polyethylene glycol, and the like), and suitable mixtures thereof. The proper fluidity can be maintained, for example, by the use of a coating such as lecithin, by the maintenance of the required particle size in the case of dispersion and by the use of surfactants. Prevention of the action of microorganisms can be achieved by various anti-bacterial and anti-fungal agents, for example, parabens, chlorobutanol, phenol, ascorbic acid, thimerosal, and the like. In many cases, it will be preferable to include isotonic agents, for example, sugars, polyalcohols such as mannitol, sorbitol, or sodium chloride in the composition. Prolonged absorption of the injectable compositions can be brought about by including in the composition an agent which delays absorption, for example, aluminum monostearate and gelatin.

Sterile injectable solutions can be prepared by incorporating the active compound (e.g., a polypeptide or antibody) in the required amount in an appropriate solvent with one or a combination of ingredients enumerated above, as required, followed by filtered sterilization. Generally, dispersions are prepared by incorporating the active compound into a sterile vehicle which contains a basic dispersion medium, and then incorporating the required other ingredients from those enumerated above. In the case of sterile powders for the preparation of sterile injectable solutions, examples of methods of preparation are vacuum drying and freeze-drying which yields a powder of the active ingredient plus any additional desired ingredient from a previously sterile-filtered solution thereof.

Oral compositions generally include an inert diluent or an edible carrier. They can be enclosed in gelatin capsules or compressed into tablets. For the purpose of oral therapeutic administration, the active compound can be incorporated with excipients and used in the form of tablets, troches, or capsules. Oral compositions can also be prepared using a fluid carrier for use as a mouthwash, wherein the compound in the fluid carrier is applied orally and swished and expectorated or swallowed.

Pharmaceutically compatible binding agents, adjuvant materials, or both, can be included as part of the composition. The tablets, pills, capsules, troches, and the like can contain any of the following ingredients, or compounds of a similar nature: a binder such as microcrystalline cellulose, gum tragacanth or gelatin; an excipient such as starch or lactose, a disintegrating agent such as alginic acid, PRIMOGEL™, or corn starch; a lubricant such as magnesium stearate or Sterotes; a glidant such as colloidal silicon dioxide; a sweetening agent such as sucrose or saccharin; or a flavoring agent such as peppermint, methyl salicylate, or orange flavoring.

For administration by inhalation, the compounds are delivered in the form of an aerosol spray from a pressurized container or dispenser which contains a suitable propellant, e.g., a gas such as carbon dioxide, or a nebulizer.

Systemic administration can also be by transmucosal or transdermal means. For transmucosal or transdermal administration, penetrants appropriate to the barrier to be permeated are used in the formulation. Such penetrants are generally known in the art, and include, for example, for transmucosal administration, detergents, bile salts, and fusidic acid derivatives. Transmucosal administration can be accomplished through the use of nasal sprays or suppositories. For transdermal administration, the active compounds are formulated into ointments, salves, gels, or creams as generally known in the art.

The compounds can also be prepared in the form of suppositories (e.g., with conventional suppository bases such as cocoa butter and other glycerides) or retention enemas for rectal delivery.

In one embodiment, the active compounds are prepared with carriers that will protect the compound against rapid elimination from the body, such as a controlled release formulation, including implant and microencapsulated delivery systems. Biodegradable, biocompatible polymers can be used, such as ethylene vinyl acetate, polyanhydrides, polyglycolic acid, collagen, polyorthoesters, and polylactic acid. Methods for preparation of such formulations will be apparent to those skilled in the art. The materials can also be obtained commercially from Alza Corporation and Nova Pharmaceuticals, Inc. Liposomal suspensions (including liposomes having monoclonal antibodies incorporated therein or thereon) can also be used as pharmaceutically acceptable carriers. These can be prepared according to methods known to those skilled in the art, for example, as described in U.S. Pat. No. 4,522,811.

It is especially advantageous to formulate oral or parenteral compositions in dosage unit form for ease of administration and uniformity of dosage. Dosage unit form as used herein refers to physically discrete units suited as unitary dosages for the subject to be treated; each unit containing a predetermined quantity of active compound calculated to produce the desired therapeutic effect in association with the required pharmaceutical carrier. The specification for the dosage unit forms of the invention are dictated by and directly dependent on the unique characteristics of the active compound and the particular therapeutic effect to be achieved, and the limitations inherent in the art of compounding such an active compound for the treatment of individuals.

Generally, partially human antibodies and fully human antibodies have a longer half-life within the human body than other antibodies. Accordingly, lower dosages and less frequent administration is often possible. Modifications such as lipidation can be used to stabilize antibodies and to enhance uptake and tissue penetration (e.g., into the brain). A method for lipidation of antibodies is described by Cruikshank et al. ((1997) J. Acquired Immune Deficiency Syndromes and Human Retrovirology 14:193).

The nucleic acid molecules of the invention can be inserted into vectors and used as gene therapy vectors. Gene therapy vectors can be delivered to a subject by, for example, intravenous injection, local administration (U.S. Pat. No. 5,328,470), or by stereotactic injection (see, e.g., Chen et al. (1994) Proc. Natl. Acad. Sci. USA 91:3054-3057). The pharmaceutical preparation of the gene therapy vector can include the gene therapy vector in an acceptable diluent, or can comprise a slow release matrix in which the gene delivery vehicle is imbedded. Alternatively, where the complete gene delivery vector can be produced intact from recombinant cells, e.g., retroviral vectors, the pharmaceutical preparation can include one or more cells which produce the gene delivery system.

It is recognized that the pharmaceutical compositions and methods described herein can be used independently or in combination with one another. That is, subjects can be administered one or more of the pharmaceutical compositions, e.g., pharmaceutical compositions comprising a nucleic acid molecule or protein of the invention or a modulator thereof, subjected to one or more of the therapeutic methods described herein, or both, in temporally overlapping or non-overlapping regimens. When therapies overlap temporally, the therapies may generally occur in any order and can be simultaneous (e.g., administered simultaneously together in a composite composition or simultaneously but as separate compositions) or interspersed. By way of example, a subject afflicted with a disorder described herein can be simultaneously or sequentially administered both a cytotoxic agent which selectively kills aberrant cells and an antibody (e.g., an antibody of the invention) which can, in one embodiment, be conjugated or linked with a therapeutic agent, a cytotoxic agent, an imaging agent, or the like.

The pharmaceutical compositions can be included in a container, pack, or dispenser together with instructions for administration.

V. Uses and Methods of the Invention

The nucleic acid molecules, proteins, protein homologs, and antibodies described herein can be used in one or more of the following methods: a) screening assays; b) detection assays (e.g., chromosomal mapping, tissue typing, forensic biology); c) predictive medicine (e.g., diagnostic assays, prognostic assays, monitoring clinical trials, and pharmacogenomics); and d) methods of treatment (e.g., therapeutic and prophylactic). For example, polypeptides of the invention can to used for all of the purposes identified herein in portions of the disclosure relating to individual types of protein of the invention. The isolated nucleic acid molecules of the invention can be used to express proteins (e.g., via a recombinant expression vector in a host cell in gene therapy applications), to detect mRNA (e.g., in a biological sample) or a genetic lesion, and to modulate activity of a polypeptide of the invention. In addition, the polypeptides of the invention can be used to screen drugs or compounds which modulate activity or expression of a polypeptide of the invention as well as to treat disorders characterized by insufficient or excessive production of a protein of the invention or production of a form of a protein of the invention which has decreased or aberrant activity compared to the wild type protein. In addition, the antibodies of the invention can be used to detect and isolate a protein of the and modulate activity of a protein of the invention.

This invention further pertains to novel agents identified by the above-described screening assays and uses thereof for treatments as described herein.

A. Screening Assays

The invention provides a method (also referred to herein as a "screening assay") for identifying modulators, i.e., candidate or test compounds or agents (e.g., peptides, peptidomimetics, small molecules or other drugs) which bind with a polypeptide of the invention or have a stimulatory or inhibitory effect on, for example, expression or activity of a polypeptide of the invention.

In one embodiment, the invention provides assays for screening candidate or test compounds which bind with or modulate the activity of the membrane-bound form of a polypeptide of the invention or biologically active portion thereof. The test compounds of the present invention can be obtained using any of the numerous approaches in combinatorial library methods known in the art, including: biological libraries; spatially addressable parallel solid phase or solution phase libraries; synthetic library methods requiring deconvolution; the "one-bead one-compound" library method; and synthetic library methods using affinity chromatography selection. The biological library approach is limited to peptide libraries, while the other four approaches are applicable to peptide, non-peptide oligomer, or small molecule libraries of compounds (Lam (1997) Anticancer Drug Des. 12:145).

Examples of methods useful for the synthesis of molecular libraries can be found in the art, for example in: DeWitt et al. (1993) Proc. Natl. Acad. Sci. USA 90:6909; Erb et al. (1994) Proc. Natl. Acad. Sci. USA 91:11422; Zuckermann et al. (1994). J. Med. Chem. 37:2678; Cho et al. (1993) Science 261:1303; Carrell et al. (1994) Angew. Chem. Int. Ed.

Engl. 33:2059; Carell et al. (1994) Angew. Chem. Int. Ed. Engl. 33:2061; and Gallop et al. (1994) J. Med. Chem. 37:1233.

Libraries of compounds can be presented in solution (e.g., Houghten (1992) Bio/Techniques 13:412-421), or on beads (Lam (1991) Nature 354:82-84), chips (Fodor (1993) Nature 364:555-556), bacteria (U.S. Pat. No. 5,223,409), spores (U.S. Pat. Nos. 5,571,698; 5,403,484; and 5,223,409), plasmids (Cull et al. (1992) Proc. Natl. Acad. Sci. USA 89:1865-1869) or phage (Scott and Smith (1990) Science 249:386-390; Devlin (1990) Science 249:404-406; Cwirla et al. (1990) Proc. Natl. Acad. Sci. USA 87:6378-6382; and Felici (1991) J. Mol. Biol. 222:301-310).

In one embodiment, an assay is a cell-based assay in which a cell which expresses a membrane-bound form of a polypeptide of the invention, or a biologically active portion thereof, on the cell surface is contacted with a test compound and the ability of the test compound to bind with the polypeptide is determined. The cell, for example, can be a yeast cell or a cell of mammalian origin. Determining the ability of the test compound to bind with the polypeptide can be accomplished, for example, by coupling the test compound with a radioisotope or enzymatic label such that binding of the test compound to the polypeptide or biologically active portion thereof can be determined by detecting the labeled compound in a complex. For example, test compounds can be labeled with $^{125}I$, $^{35}S$, $^{14}C$, or $^{3}H$, either directly or indirectly, and the radioisotope detected by direct counting of radio-emission or by scintillation counting. Alternatively, test compounds can be enzymatically labeled with, for example, horseradish peroxidase, alkaline phosphatase, or luciferase, and the enzymatic label detected by determination of conversion of an appropriate substrate to product. In one embodiment, the assay comprises contacting a cell which expresses a membrane-bound form of a polypeptide of the invention, or a biologically active portion thereof, on the cell surface with a known compound which binds the polypeptide to form an assay mixture, contacting the assay mixture with a test compound, and determining the ability of the test compound to interact with the polypeptide, wherein determining the ability of the test compound to interact with the polypeptide comprises determining the ability of the test compound to preferentially bind with the polypeptide or a biologically active portion thereof as compared to the known compound.

In another embodiment, the assay involves assessment of an activity characteristic of the polypeptide, wherein binding of the test compound with the polypeptide or a biologically active portion thereof alters (i.e., increases or decreases) the activity of the polypeptide.

In another embodiment, an assay is a cell-based assay comprising contacting a cell expressing a membrane-bound form of a polypeptide of the invention, or a biologically active portion thereof, on the cell surface with a test compound and determining the ability of the test compound to modulate (e.g., stimulate or inhibit) the activity of the polypeptide or biologically active portion thereof. Determining the ability of the test compound to modulate the activity of the polypeptide or a biologically active portion thereof can be accomplished, for example, by determining the ability of the polypeptide to bind with or interact with a target molecule or to transport molecules across the cytoplasmic membrane.

Determining the ability of a polypeptide of the invention to bind with or interact with a target molecule can be accomplished by one of the methods described above for determining direct binding. As used herein, a "target molecule" is a molecule with which a selected polypeptide (e.g., a polypeptide of the invention binds or interacts with in nature, for example, a molecule on the surface of a cell which expresses the selected protein, a molecule on the surface of a second cell, a molecule in the extracellular milieu, a molecule associated with the internal surface of a cell membrane or a cytoplasmic molecule. A target molecule can be a polypeptide of the invention or some other polypeptide or protein. For example, a target molecule can be a component of a signal transduction pathway which facilitates transduction of an extracellular signal (e.g., a signal generated by binding of a compound to a polypeptide of the invention) through the cell membrane and into the cell or a second intercellular protein which has catalytic activity or a protein which facilitates association of downstream signaling molecules with a polypeptide of the invention. Determining the ability of a polypeptide of the invention to bind with or interact with a target molecule can be accomplished by determining the activity of the target molecule. For example, the activity of the target molecule can be determined by detecting induction of a cellular second messenger of the target (e.g., an mRNA, intracellular $Ca^{2+}$, diacylglycerol, IP3, and the like), detecting catalytic/enzymatic activity of the target on an appropriate substrate, detecting induction of a reporter gene (e.g., a regulatory element that is responsive to a polypeptide of the invention operably linked with a nucleic acid encoding a detectable marker, e.g., luciferase), or detecting a cellular response, for example, cellular differentiation, or cell proliferation.

In yet another embodiment, an assay of the present invention is a cell-free assay comprising contacting a polypeptide of the invention or biologically active portion thereof with a test compound and determining the ability of the test compound to bind with the polypeptide or biologically active portion thereof. Binding of the test compound with the polypeptide can be determined either directly or indirectly as described above. In one embodiment, the assay includes contacting the polypeptide of the invention or biologically active portion thereof with a known compound which binds the polypeptide to form an assay mixture, contacting the assay mixture with a test compound, and determining the ability of the test compound to interact with the polypeptide, wherein determining the ability of the test compound to interact with the polypeptide comprises determining the ability of the test compound to preferentially bind with the polypeptide or biologically active portion thereof as compared to the known compound.

In another embodiment, an assay is a cell-free assay comprising contacting a polypeptide of the invention or biologically active portion thereof with a test compound and determining the ability of the test compound to modulate (e.g., stimulate or inhibit) the activity of the polypeptide or biologically active portion thereof. Determining the ability of the test compound to modulate activity of the polypeptide can be accomplished, for example, by determining the ability of the polypeptide to bind with a target molecule by one of the methods described above for determining direct binding. In an alternative embodiment, determining the ability of the test compound to modulate the activity of the polypeptide can be accomplished by determining the ability of the polypeptide of the invention to further modulate the target molecule. For example, the catalytic activity, the enzymatic activity, or both, of the target molecule on an appropriate substrate can be determined as previously described.

In yet another embodiment, the cell-free assay comprises contacting a polypeptide of the invention or biologically active portion thereof with a known compound which binds the polypeptide to form an assay mixture, contacting the assay mixture with a test compound, and determining the ability of the test compound to interact with the polypeptide. Ability of the test compound to interact with the polypeptide can be determined by assessing the ability of the polypeptide to preferentially bind with or modulate the activity of a target molecule, or by any other method.

The cell-free assays of the present invention are amenable to use of either soluble or membrane-bound forms (where applicable) of a polypeptide of the invention. In the case of cell-free assays comprising a membrane-bound form of the polypeptide, it can be desirable to use a solubilizing agent in order to maintain the membrane-bound form of the polypeptide in solution. Examples of such solubilizing agents include non-ionic detergents such as n-octylglucoside, n-dodecylglucoside, n-octylmaltoside, octanoyl-N-methylglucamide, decanoyl-N-methylglucamide, Triton X-100, Triton X-114, Thesit, isotridecypoly(ethylene glycol ether)n, 3-{(3-cholamidopropyl) dimethylamminio}-1-propane sulfonate (CHAPS), 3-{(3-cholamidopropyl) dimethylamminio}-2-hydroxy-1-propane sulfonate (CHAPSO), or N-dodecyl-N,N-dimethyl-3-ammonio-1-propane sulfonate.

In one or more embodiments of the above assay methods of the present invention, it can be desirable to immobilize either the polypeptide of the invention or its target molecule in order to facilitate separation of complexed and non-complexed forms of one or both of the molecules, as well as to accommodate automation of the assay. Binding of a test compound with the polypeptide, or interaction of the polypeptide with a target molecule in the presence and absence of a candidate compound, can be accomplished in any vessel suitable for containing the reactants. Examples of such vessels include microtiter plates, test tubes, and micro-centrifuge tubes. In one embodiment, a fusion protein can be provided which adds a domain that allows one or both of the proteins to be bound to a matrix. For example, glutathione-S-transferase fusion proteins or glutathione-S-transferase fusion proteins can be adsorbed onto glutathione SEPHAROSE™ beads (Sigma Chemical; St. Louis, Mo.) or glutathione-derivatized microtiter plates, which are combined with the test compound and either the non-adsorbed target protein or a polypeptide of the invention. The combination is incubated under conditions conducive to complex formation (e.g., at physiological conditions for salt and pH). Following incubation, the beads or microtiter plate wells are washed to remove unbound components, and complex formation is measured directly or indirectly, for example, as described above. Alternatively, the complexes can be dissociated from the matrix, and the level of binding or activity of the polypeptide of the invention can be determined using standard techniques, such as those described herein.

Other techniques for immobilizing proteins on matrices can also be used in the screening assays of the invention. For example, either the polypeptide of the invention or a target molecule thereof (e.g., a protein which binds therewith or a substrate or an analog of a substrate of the protein of the invention) can be immobilized using conjugation of biotin and streptavidin. Biotinylated polypeptide of the invention or target molecules can be prepared using biotin-NHS (biotin-N-hydroxy-succinimide) using techniques well known in the art (e.g., using a commercially available kit such as the biotinylation kit manufactured by Pierce Chemical Co.; Rockford, Ill.), and immobilized in the wells of streptavidin-coated 96-well plates (Pierce Chemical). Alternatively, antibodies which are reactive with the polypeptide of the invention or target molecules but which do not interfere with binding of the polypeptide of the invention with its target molecule can be derivatized to the wells of the plate, and unbound target or polypeptide of the invention can be trapped in the wells by antibody conjugation. Methods for detecting such complexes, in addition to those described above for the GST-immobilized complexes, include immunodetection of complexes using antibodies reactive with the polypeptide of the invention or target molecule, as well as enzyme-linked assays which rely on detecting an enzymatic activity associated with the polypeptide of the invention or target molecule.

In another embodiment, modulators of expression of a polypeptide of the invention are identified in a method in which a cell is contacted with a candidate compound and expression of the selected mRNA or protein (i.e., mRNA or protein corresponding to a polypeptide or nucleic acid of the invention) in the cell is determined. The level of expression of the selected mRNA or protein in the presence of the candidate compound is compared with the level of expression of the selected mRNA or protein in the absence of the candidate compound. The candidate compound can then be identified as a modulator of expression of the polypeptide of the invention based on this comparison. For example, if expression of the selected mRNA or protein is greater (i.e., statistically significantly greater) in the presence of the candidate compound than in its absence, then the candidate compound is identified as a stimulator of expression of the selected mRNA or protein. Alternatively, if expression of the selected mRNA or protein is less (i.e., statistically significantly less) in the presence of the candidate compound than in its absence, then the candidate compound is identified as an inhibitor of expression of the selected mRNA or protein. The level of the selected mRNA or protein expression in the cells can be determined by methods described herein.

In yet another aspect of the invention, a polypeptide of the invention can be used as a "bait protein" in a two-hybrid assay or three hybrid assay (see, e.g., U.S. Pat. No. 5,283,317; Zervos et al. (1993) Cell 72:223-232; Madura et al. (1993) J. Biol. Chem. 268:12046-12054; Bartel et al. (1993) Bio/Techniques 14:920-924; Iwabuchi et-al. (1993) Oncogene 8:1693-1696; and PCT Publication No. WO 94/10300), to identify other proteins which bind with or interact with the polypeptide of the invention and modulate activity of the polypeptide of the invention. Such binding proteins are also likely to be involved in the propagation of signals by the polypeptide of the inventions as, for example, upstream or downstream elements of a signaling pathway involving the polypeptide of the invention.

This invention further pertains to novel agents identified by the above-described screening assays and uses thereof for treatments as described herein.

B. Detection Assays

Portions or fragments of the cDNA sequences identified herein (and the corresponding complete gene sequences) can be used in numerous ways as polynucleotide reagents. For example, these sequences can be used to: (i) map their respective genes on a chromosome and, thus, locate gene regions associated with genetic disease; (ii) identify an individual from a minute biological sample (tissue typing); and (iii) aid in forensic identification of a biological sample. These applications are described in the subsections below.

1. Chromosome Mapping

Once the sequence (or a portion of the sequence) of a gene has been isolated, this sequence can be used to map the location of the gene on a chromosome. Accordingly, nucleic acid molecules described herein or fragments thereof, can be used to map the location of the corresponding genes on a chromosome. Mapping of sequences to chromosomes is an important first step in correlating these sequences with genes associated with occurrence of disease. For example, the TANGO 457 gene maps to human chromosome 11p14.3; the TANGO 416 gene maps to human chromosome 4 between chromosomal markers D4S422 and D4S1576; the INTERCEPT 400 gene maps to human chromosome 4 between markers D4S1616 and D4S1611; the TANGO 331 gene maps to human chromosome 22 at 22q11-q13, between markers WI-4572 and WI-8917; the TANGO 265 gene maps to human chromosome 1 between markers D1S305 and D1S2635; and the TANGO 286 gene maps to human chromosome 22 at 22q12-13.

Briefly, genes can be mapped to chromosomes by preparing PCR primers (preferably 15-25 nucleotide residues in length) from the sequence of a gene of the invention. Computer analysis of the sequence of a gene of the invention can be used to rapidly select primers that do not span more than one exon in the genomic DNA, which would complicate the amplification process. These primers can be used for PCR screening of somatic cell hybrids containing individual human chromosomes. Only those hybrids containing the human gene corresponding to the gene sequences will yield an amplified fragment. For a review of this technique, see D'Eustachio et al. ((1983) Science 220:919-924).

PCR mapping of somatic cell hybrids is a rapid procedure for assigning a particular sequence to a particular chromosome. Three or more sequences can be assigned per day using a single thermal cycler. Using one or more nucleic acid sequences of the invention to design oligonucleotide primers, sub-localization can be achieved using panels of fragments prepared from specific chromosomes. Other mapping strategies which can similarly be used to map a gene to its chromosomal location include in situ hybridization (described in Fan et al. (1990) Proc. Natl. Acad. Sci. USA 87:6223-27), pre-screening with labeled flow-sorted chromosomes, and pre-selection by hybridization with chromosome specific cDNA libraries. Fluorescence in situ hybridization (FISH) of a DNA sequence using a metaphase chromosomal spread can be used to provide a precise chromosomal location in one step. For a review of this technique, see Verma et al. (Human Chromosomes: A Manual of Basic Techniques (Pergamon Press, New York, 1988)).

Reagents for chromosome mapping can be used individually to mark a single chromosome or a single site on a chromosome. Alternatively, panels of reagents can be used for marking multiple sites, multiple chromosomes, or both. Reagents corresponding to non-coding regions of the genes actually are preferred for mapping purposes. Coding sequences are more likely to be conserved within gene families, thus increasing the chance of cross-hybridization during chromosomal mapping.

Once a sequence has been mapped to a precise chromosomal location, the physical position of the sequence on the chromosome can be correlated with genetic map data. (Such data are found, for example, in V. McKusick, Mendelian Inheritance in Man, available on-line through Johns Hopkins University Welch Medical Library). The relationship between genes and disease, mapped to the same chromosomal region, can then be identified by linkage analysis (co-inheritance of physically adjacent genes), described in, e.g., Egeland et al. (1987) Nature 325:783-787.

Moreover, differences in the DNA sequences between individuals affected and non-affected with a disease associated with a gene of the invention can be determined. If a mutation is observed in some or all of the affected individuals, but not in any (or in very few) non-affected individuals, then the mutation is likely to be the causative agent of the particular disease. Comparison of affected and non-affected individuals generally involves first looking for structural alterations in the chromosomes such as deletions or translocations that are visible from chromosome spreads or detectable using PCR based on that DNA sequence. Ultimately, complete sequencing of genes from several individuals can be performed to confirm the presence of a mutation and to distinguish mutations from polymorphisms.

2. Tissue Typing

The nucleic acid sequences of the present invention can also be used to identify individuals from minute biological samples. The United States military, for example, is considering the use of restriction fragment length polymorphism (RFLP) for identification of its personnel. In this technique, an individual's genomic DNA is digested with one or more restriction enzymes, and probed on a Southern blot to yield unique bands for identification. This method does not suffer from the current limitations of physical identification devices such as general issue "dog tags," which can be lost, switched, or stolen, making positive identification difficult. The sequences of the present invention are useful as additional DNA markers for RFLP (described in U.S. Pat. No. 5,272, 057).

Furthermore, the sequences of the present invention can be used to provide an alternative technique which determines the actual base-by-base DNA sequence of selected portions of an individual's genome. The nucleic acid sequences described herein can be used to prepare two PCR primers from the 5' and 3' ends of the sequences. These primers can then be used to amplify an individual's DNA and to subsequently sequence it.

Panels of corresponding DNA sequences from individuals, prepared in this manner, can provide unique individual identifications, because (with the exception of identical twins) every individual has a unique set of such DNA sequences owing, at least in part, to allelic differences. Sequences of the present invention can be used to obtain such identification sequences from individuals and from tissue. The nucleic acid sequences of the invention uniquely represent portions of the human genome. Allelic variation occurs to some degree in the coding regions of these sequences, and to a greater degree in the non-coding regions. It is estimated that allelic variation between individual humans occurs with a frequency of about once per 500 nucleotide residues. Each of the sequences described herein can, to some degree, be used as a standard against which DNA from an individual can be compared for identification purposes. Because greater numbers of polymorphisms occur in the non-coding regions, fewer non-coding sequences are necessary to differentiate individuals. The non-coding sequences of any of SEQ ID NOs: 1, 31, 51, 71, 81, 91, 96, 101, 106, 111, 121, 141, 151, 171, 181, 191, 201, 215, 221, 241, 251, 271, 279, 303, 308, 324, 329, 351, 371, 379, 387, 403, 415, 423, and 437 can comfortably provide positive individual identification with a panel of perhaps 10 to 1,000 primers which each yield a non-coding amplified sequence of 100 bases. If predicted coding sequences, such as those in any of SEQ ID NOs: 2, 32, 52, 72, 82, 92, 97, 102, 107, 112, 122, 142, 152, 162, 172, 182, 192, 202, 215, 222, 242, 252, 272, 280, 304, 309, 325, 330, 352, 362, 372, 380, 388, 404, 416, 424, and 438are used, a more appropriate number of primers for positive individual identification would be 500-2,000.

If a panel of reagents from the nucleic acid sequences described herein is used to generate a unique identification database for an individual, those same reagents can later be used to identify nucleic acids, cells, or tissue from that individual. Using the unique identification database, positive identification of the individual, living or dead, can be made from extremely small samples.

3. Use of Partial Gene Sequences in Forensic Biology

DNA-based identification techniques can be used in forensic biology. Forensic biology is a scientific field employing genetic typing of biological evidence found at a crime scene as a means for positively identifying, for example, a perpetrator of a crime. To make such an identification, PCR technology can be used to amplify DNA sequences taken from very small biological samples such as tissues (e.g., hair or skin) or body fluids (e.g., blood, saliva, or semen) found at a crime scene. The amplified sequence can be compared with a standard, thereby allowing identification of the origin of the biological sample.

The sequences of the present invention can be used to provide polynucleotide reagents (e.g., PCR primers) targeted to specific loci in the human genome, which can enhance the reliability of DNA-based forensic identifications by, for example, providing another "identification marker" (i.e., another DNA sequence that is unique to a particular individual). As mentioned above, actual nucleotide sequence information can be used for identification as an accurate alternative to patterns formed by restriction enzyme-generated fragments. Sequences of non-coding regions are particularly appropriate for this use, because greater numbers of polymorphisms occur in non-coding regions, making it easier to differentiate individuals using this technique. Examples of polynucleotide reagents include the nucleic acid sequences of the invention or portions thereof, e.g., fragments derived from non-coding regions having a length of at least 20 or 30 nucleotide residues.

The nucleic acid sequences described herein can further be used to provide polynucleotide reagents, e.g., labeled or labelable probes which can be used in, for example, an in situ hybridization technique, to identify a specific tissue, e.g., brain tissue. This can be very useful in cases where a forensic pathologist is presented with a tissue of unknown origin. Panels of such probes can be used to identify tissue by species and/or by organ type.

C. Predictive Medicine

The present invention also pertains to the field of predictive medicine in which diagnostic assays, prognostic assays, and monitoring clinical trials are used for prognostic (predictive) purposes to thereby treat an individual prophylactically. Accordingly, one aspect of the present invention relates to diagnostic assays for determining expression of a gene encoding a polypeptide of the invention as well as activity of a polypeptide of the invention, in the context of a biological sample (e.g., blood, serum, cells, tissue) to thereby determine whether an individual is afflicted with a disease or disorder, or is at risk of developing a disorder, associated with aberrant or unwanted expression of a gene encoding a polypeptide of the invention or aberrant or unwanted activity of a polypeptide of the invention. The invention also provides for prognostic (or predictive) assays for determining whether an individual is at risk of developing a disorder associated with a protein of the invention, with expression of a nucleic acid encoding a polypeptide of the invention, or with activity of a polypeptide of the invention. For example, mutations in a gene encoding a polypeptide of the invention can be assayed in a biological sample. Such assays can be used for prognostic or predictive purpose to thereby prophylactically treat an individual prior to the onset of a disorder characterized by or associated with a polypeptide of the invention, expression of a nucleic acid encoding it, or its activity.

As an alternative to making determinations based on the absolute expression level of selected genes, determinations may be based on the normalized expression levels of these genes. Expression levels are normalized by correcting the absolute expression level of a gene encoding a polypeptide of the invention by comparing its expression to the expression of a different gene, e.g., a housekeeping gene that is constitutively expressed. Suitable genes for normalization include housekeeping genes such as the actin gene. This normalization allows the comparison of the expression level in one sample (e.g., a patient sample), to another sample, or between samples from different sources.

Alternatively, the expression level can be provided as a relative expression level. To determine a relative expression level of a gene, the level of expression of the gene is determined for 10 or more samples of different endothelial (e.g. intestinal endothelium, airway endothelium, or other mucosal epithelium) cell isolates, preferably 50 or more samples, prior to the determination of the expression level for the sample in question. The mean expression level of each of the genes assayed in the larger number of samples is determined and this is used as a baseline expression level for the gene(s) in question. The expression level of the gene determined for the test sample (absolute level of expression) is then divided by the mean expression value obtained for that gene. This provides a relative expression level and aids in identifying extreme cases of disorders associated with aberrant expression of a gene encoding a polypeptide of the invention protein or with aberrant expression of a ligand thereof.

Preferably, the samples used in the baseline determination will be from either or both of cells which aberrantly express a gene encoding a polypeptide of the invention or a ligand thereof (i.e. 'diseased cells') and cells which express a gene encoding a polypeptide of the invention at a normal level or a ligand thereof (i.e. 'normal' cells). The choice of the cell source is dependent on the use of the relative expression level. Using expression found in normal tissues as a mean expression score aids in validating whether aberrance in expression of a gene encoding a polypeptide of the invention occurs specifically in diseased cells. Such a use is particularly important in identifying whether a gene encoding a polypeptide of the invention can serve as a target gene. In addition, as more data is accumulated, the mean expression value can be revised, providing improved relative expression values based on accumulated data. Expression data from endothelial cells (e.g. mucosal endothelial cells) provides a means for grading the severity of the disorder.

Another aspect of the invention pertains to monitoring the influence of agents (e.g., drugs, antibodies, antisense oligonucleotides, or other compounds) on the expression or activity of a polypeptide of the invention in clinical trials.

These and other agents are described in further detail in the following sections.

1. Diagnostic Assays

An example of a method for detecting the presence or absence of a polypeptide or nucleic acid of the invention in a biological sample involves obtaining a biological sample from a test subject and containing the biological sample with a compound or an agent capable of detecting a polypeptide or nucleic acid (e.g., mRNA, genomic DNA) of the invention. An example of an agent for detecting mRNA or genomic DNA encoding a polypeptide of the invention is a labeled nucleic acid probe capable of hybridizing with mRNA or genomic DNA encoding a polypeptide of the invention. The nucleic acid probe can be, for example, a full-length cDNA, such as the nucleic acid of one of SEQ ID NOs: 1, 31, 51, 71, 81, 91, 96, 101, 106, 111, 121, 141, 151, 171, 181, 191, 201, 217, 221, 241, 251, 271, 279, 303, 308, 324, 329, 351, 371, 379, 387, 403, 415, 423, and 437, or a portion thereof, such as an oligonucleotide of at least 15, 30, 50, 100, 250 or 500 nucleotides in length and sufficient to specifically hybridize under stringent conditions with a mRNA or genomic DNA encoding a polypeptide of the invention. Other suitable probes for use in the diagnostic assays of the invention are described herein.

An example of an agent for detecting a polypeptide of the invention is an antibody capable of binding with a polypeptide of the invention, such as an antibody having a detectable label. Antibodies can be polyclonal or, preferably, monoclonal. An intact antibody, or a fragment thereof (e.g., Fab or F(ab')$_2$) can be used. The term "labeled," with regard to the probe or antibody, includes direct labeling of the probe or antibody by coupling (i.e., physically linking) a detectable substance to the probe or antibody, as well as indirect labeling of the probe or antibody by coupling it with another reagent that is directly labeled. Examples of indirect labeling include detection of a primary antibody using a fluorescently labeled secondary antibody and end-labeling of a DNA probe with biotin such that it can be detected with fluorescently labeled streptavidin. The term "biological sample" is intended to include tissues, cells, and biological fluids isolated from a subject, as well as tissues, cells, and fluids present within a subject. That is, the detection method of the invention can be used to detect mRNA, protein, or genomic DNA in a biological sample in vitro as well as in vivo. For example, in vitro techniques for detection of mRNA include Northern hybridization methods and in situ hybridization methods. In vitro techniques for detection of a polypeptide of the invention include enzyme linked immunosorbent assays (ELISAs), Western blots, immunoprecipitation, and immunofluorescence. In vitro techniques for detection of genomic DNA include Southern hybridizations. Furthermore, in vivo techniques for detection of a polypeptide of the invention include introducing into a subject a labeled antibody directed against the polypeptide. For example, the antibody can be labeled with a radioactive marker, the presence and location of which in a subject can be detected using standard imaging techniques.

In one embodiment, the biological sample contains protein molecules obtained from the test subject. Alternatively, the biological sample can contain mRNA molecules obtained from the test subject or genomic DNA molecules obtained from the test subject. An example of a biological sample is a peripheral blood leukocyte-containing sample obtained by conventional means from a subject (e.g., isolated peripheral blood leukocytes).

In another embodiment, the methods further involve obtaining a control biological sample from a control (i.e., non-afflicted) subject, contacting the control sample with a compound or agent capable of detecting a polypeptide of the invention or mRNA or genomic DNA encoding a polypeptide of the invention. The presence or amount of the polypeptide, mRNA, or genomic DNA encoding the polypeptide in the control and test samples can be compared t6 assess the degree, if any, to which the presence or amount in the test sample differs from that in the control sample.

The invention also encompasses kits for detecting the presence of a polypeptide or nucleic acid of the invention in a biological sample obtained from a subject. Such kits can be used to determine if a subject is suffering from or is at increased risk of developing a disorder associated with aberrant expression of a polypeptide of the invention (e.g., one of the disorders described in the section of this disclosure wherein the individual polypeptide of the invention is discussed). For example, the kit can comprise a labeled compound or agent capable of detecting the polypeptide or mRNA encoding the polypeptide in a biological sample. The kit can also, or alternatively, contain means for determining the amount of the polypeptide or mRNA in the sample (e.g., an antibody which specifically binds with the polypeptide or an oligonucleotide probe which binds with a nucleic acid encoding the polypeptide). Kits can include instructions for assessing whether the tested subject is suffering from or is at risk of developing a disorder associated with aberrant expression of the polypeptide if the amount of the polypeptide or mRNA encoding the polypeptide is above or below a normal level.

For antibody-based kits, the kit can comprise, for example: (1) a first antibody (e.g., attached to a solid support) which specifically binds with a polypeptide of the invention; and, optionally, (2) a second, different antibody which specifically binds with either the polypeptide or the first antibody and is conjugated with a detectable agent.

For oligonucleotide-based kits, the kit can comprise, for example: (1) an oligonucleotide (e.g., a detectably labeled oligonucleotide) which hybridizes with a nucleic acid encoding a polypeptide of the invention or (2) a pair of primers useful for amplifying a nucleic acid encoding a polypeptide of the invention. The kit can comprise, for example, a buffering agent, a preservative, or a protein stabilizing agent. The kit can also comprise components necessary for detecting the detectable agent (e.g., an enzyme or a substrate). The kit can contain a control sample or a series of control samples which can be assayed and compared with the test sample assay results. Each component of the kit can be enclosed within an individual container and all of the various containers can furthermore be within a single package, optionally with instructions for assessing whether the tested subject is suffering from or is at risk of developing a disorder associated with aberrant expression of the polypeptide.

2. Prognostic Assays

The methods described herein can furthermore be used as diagnostic or prognostic assays to identify subjects having or at risk of developing a disease or disorder associated with aberrant expression or activity of a polypeptide of the invention (e.g., one of the disorders described in the section of this disclosure wherein the individual polypeptide of the invention is discussed). Thus, the present invention provides a method in which a test sample is obtained from a subject and a polypeptide or nucleic acid (e.g., mRNA, genomic DNA) of the invention is detected, wherein the presence, level, or activity of the polypeptide or nucleic acid in the sample is associated with an enhanced or diminished risk of developing a disease or disorder associated with aberrant expression or activity of the polypeptide.

Furthermore, the prognostic assays described herein can be used to determine whether an agent (e.g., an agonist, antagonist, peptidomimetic, protein, peptide, nucleic acid, small molecule, or other drug candidate) can be administered to a subject in order to treat a disease or disorder associated with aberrant expression or activity of a polypeptide of the invention. For example, such methods can be used to determine whether a subject can be effectively treated using a specific agent or class of agents (e.g., agents of a type which decrease activity of the polypeptide). Thus, the present invention provides methods for determining whether an agent can be administered to a subject in order to effectively treat a disorder associated with aberrant expression or activity of a polypeptide of the invention. When efficacious agents are known or found, such assays can also be used to estimate tan efficacious dose of the agent.

The methods of the invention can be used to detect genetic lesions or mutations in a gene of the invention in order to assess if a subject having the lesioned or mutated gene is at risk for a disorder characterized aberrant expression or activity of a polypeptide of the invention. In certain embodiments, the methods include detecting, in a sample of cells obtained from the subject, the presence or absence of a genetic lesion or mutation characterized by at least one of an alteration affecting the integrity of a gene encoding the polypeptide of the invention, or the mis-expression of the gene encoding the polypeptide of the invention. For example, such genetic lesions or mutations can be detected by ascertaining the existence of at least one of: 1) a deletion of one or more nucleotides from the gene; 2) an addition of one or more nucleotides to the gene; 3) a substitution of one or more nucleotides of the gene; 4) a chromosomal rearrangement of the gene; 5) an alteration in the level of a messenger RNA transcript of the gene; 6) an aberrant modification of the gene, such as of the methylation pattern of the genomic DNA; 7) a non-wild type splicing pattern of a messenger RNA transcript of the gene; 8) a non-wild type level of the protein encoded by the gene; 9) an allelic loss of the gene; and 10) an inappropriate post-translational modification of the protein encoded by the gene. As described herein, there are a large number of assay techniques known in the art which can be used for detecting such lesions and mutations in a gene.

In certain embodiments, detection of the lesion involves the use of an oligonucleotide primer in a polymerase chain reaction (PCR; see, e.g., U.S. Pat. Nos. 4,683,195 and 4,683,202), such as anchor PCR or RACE PCR, or, alternatively, in a ligation chain reaction (LCR; see, e.g., Landegran et al. (1988) Science 241:1077-1080; and Nakazawa et al. (1994) Proc. Natl. Acad. Sci. USA 91:360-364), the latter of which can be particularly useful for detecting point mutations in a gene (see, e.g., Abravaya et al. (1995) Nucleic Acids Res. 23:675-682). This method can include the steps of collecting a sample of cells from a patient, isolating nucleic acid (e.g., genomic, mRNA, or both) from the cells of the sample, contacting the nucleic acid sample with one or more primers which specifically hybridize with the selected gene under conditions such that hybridization and amplification of the gene (if present) occurs, and detecting the presence or absence of an amplification product. The method can also include detecting the size of the amplification product and comparing the length to the length of a corresponding product obtained in the same manner from a control sample. PCR, LCR, or both can be used as a preliminary amplification step in conjunction with any of the techniques used for detecting mutations described herein.

Alternative amplification methods include: self-sustained sequence replication (Guatelli et al. (1990) Proc. Natl. Acad. Sci. USA 87:1874-1878), transcriptional amplification system (Kwoh, et al. (1989) Proc. Natl. Acad. Sci. USA 86:1173-1177), Q-Beta Replicase (Lizardi et al. (1988) Bio/Technology 6:1197), or any other nucleic acid amplification method, followed by the detection of the amplified molecules using any of a variety of techniques well known to those of skill in the art. These detection schemes are especially useful for detection of nucleic acid molecules if such molecules are present in very low numbers.

In an alternative embodiment, mutations in a selected gene can be identified in a sample by detecting alterations in restriction enzyme cleavage patterns. For example, sample and control DNA is isolated, (optionally) amplified, digested with one or more restriction endonucleases, and fragment length sizes are determined by gel electrophoresis and compared. Differences in fragment length sizes between sample and control DNA indicates occurrence of mutations or other sequence differences in the sample DNA. Moreover, sequence specific ribozymes (see, e.g., U.S. Pat. No. 5,498,531) can be used to score for the presence of specific mutations by development or loss of a ribozyme cleavage site.

In other embodiments, genetic mutations are identified by hybridizing a sample and control nucleic acids, e.g., DNA or RNA, with high density arrays containing hundreds or thousands of oligonucleotides probes (Cronin et al. (1996) Human Mutation 7:244-255; Kozal et al. (1996) Nature Medicine 2:753-759). For example, genetic mutations can be identified using two-dimensional arrays of light-generated DNA probes fixed to a surface, as described in Cronin et al., supra. Briefly, a first hybridization array of probes can be used to scan through long stretches of DNA in a sample and control to identify base changes between the sequences by making linear arrays of sequential overlapping probes. This step allows the identification of point mutations. This step is followed by hybridization of the nucleic acid sample with a second hybridization array in order to characterize specific mutations using smaller, specialized probe arrays complementary to many or all potential variants or mutations. Each mutation array is composed of parallel probe sets, one complementary to the wild-type gene and the other complementary to the mutant gene.

In yet another embodiment, any of a variety of sequencing methods known in the art can be used to directly sequence the selected gene and detect mutations by comparing the sequence of the sample nucleic acids with the corresponding wild-type (control) sequence. Examples of sequencing reactions include those based on techniques developed by Maxim and Gilbert ((1977) Proc. Natl. Acad. Sci. USA 74:560) or Sanger ((1977) Proc. Natl. Acad. Sci. USA 74:5463). It is also contemplated that any of a variety of automated sequencing procedures can be used when performing the diagnostic assays ((1995) Bio/Techniques 19:448), including sequencing by mass spectrometry (see, e.g., PCT Publication No. WO 94/16101; Cohen et al. (1996) Adv. Chromatogr. 36:127-162; and Griffin et al. (1993) Appl.

Biochem. Biotechnol. 38:147-159).

Other methods for detecting mutations in a selected gene include methods in which protection from cleavage agents is used to detect mismatched bases in RNA/RNA or RNA/DNA heteroduplexes (Myers et al. (1985) Science 230:1242). In general, the technique of mismatch cleavage entails providing heteroduplexes formed by hybridizing (labeled) RNA or DNA containing the wild-type sequence with potentially mutant RNA or DNA obtained from a tissue sample. The double-stranded duplexes are treated with an agent that cleaves single-stranded regions of the duplex such as those which exist due to base pair mismatches between the control and sample strands. RNA/DNA duplexes can be treated with RNase to digest mismatched regions, and DNA/DNA hybrids can be treated with S1 nuclease to digest mismatched regions.

In other embodiments, DNA/DNA or RNA/DNA duplexes can be treated with hydroxylamine or osmium tetroxide and with piperidine in order to digest mismatched regions. After digestion of the mismatched regions, the resulting material is separated by size on denaturing polyacrylamide gels to determine the site of the mutated or mismatched region. See, e.g., Cotton et al. (1988) Proc. Natl. Acad. Sci. USA 85:4397; Saleeba et al. (1992) Methods Enzymol. 217:286-295. In one embodiment, the control DNA or RNA is labeled for detection.

In still another embodiment, the mismatch cleavage reaction employs one or more proteins that recognize mismatched base pairs in double-stranded DNA (so called DNA mismatch repair enzymes) in defined systems for detecting and mapping point mutations in cDNAs obtained from samples of cells. For example, the mutY enzyme of E. coli cleaves following A residues at G/A mismatches and the thymidine DNA glycosylase from HeLa cells cleaves following T residues at G/T mismatches (Hsu et al. (1994) Carcinogenesis 15:1657-1662). According to one embodiment, a probe based on a selected sequence, e.g., a wild-type sequence, is hybridized with a cDNA or other DNA product obtained from a test cell(s). The duplex is treated with a DNA mismatch repair enzyme, and the cleavage products, if any, are detected using an electrophoresis protocol or another polynucleotide-separating method. See, e.g., U.S. Pat. No. 5,459,039.

In other embodiments, alterations in electrophoretic mobility are used to identify mutations in genes. For example, single strand conformation polymorphism (SSCP) analysis can be used to detect differences in electrophoretic mobility between mutant and wild type nucleic acids (Orita et al. (1989) Proc. Natl. Acad. Sci. USA 86:2766; see also Cotton (1993) Mutat. Res. 285:125-144; Hayashi (1992) Genet. Anal. Tech. Appl. 9:73-79). Single-stranded DNA fragments of sample and control nucleic acids are denatured and allowed to re-nature. The secondary structure of single-stranded nucleic acids varies according to their nucleotide sequence, and the resulting alteration in electrophoretic mobility enables detection of even a single base change. The DNA fragments can be labeled or detected using labeled probes. The sensitivity of the assay can be enhanced by using RNA (rather than DNA), because the secondary structure of RNA is more sensitive to sequence changes. In one embodiment, the method uses heteroduplex analysis to separate double stranded heteroduplex molecules on the basis of changes in electrophoretic mobility (Keen et al. (1991) Trends Genet. 7:5).

In yet another embodiment, the movement of mutant or wild-type fragments in polyacrylamide gels containing a gradient of denaturant is assayed using denaturing gradient gel electrophoresis (DGGE), as described (Myers et al. (1985) Nature 313:495). When DGGE is used as the method of analysis, DNA is modified to ensure that it does not completely denature, for example by adding a 'GC clamp' of approximately 40 nucleotide residues of high-melting GC-rich DNA to one or both ends of the DNA strands, for example using a PCR method. In a further embodiment, a temperature gradient is used in place of a denaturing gradient to identify differences in the mobility of control and sample DNA (Rosenbaum and Reissner (1987) Biophys. Chem. 265:12753).

Examples of other techniques for detecting point mutations include, but are not limited to, selective oligonucleotide hybridization, selective amplification, and selective primer extension. For example, oligonucleotide primers can be prepared in which the known mutation is located centrally. The primers are hybridized with target DNA under conditions which permit hybridization only if a perfect complementary nucleotide sequence match occurs (Saiki et al. (1986) Nature 324:163); Saiki et al. (1989) Proc. Natl. Acad. Sci. USA 86:6230). Such allele specific oligonucleotides are hybridized with PCR-amplified target DNA or attached to a surface for hybridization.

Alternatively, allele specific amplification technology can be used in conjunction with the methods of the invention. Oligonucleotides used as primers for specific amplification have a sequence complementary to the nucleotide sequence of a mutation of interest in the center of the molecule, so that occurrence of amplification depends on occurrence of the mutation in the sample nucleic acid (Gibbs et al. (1989) Nucleic Acids Res. 17:2437-2448) or at the extreme 3' end of one primer where, under appropriate conditions, mismatching can prevent or inhibit polymerase extension (Prossner (1993) Tibtech 11:238). In addition, it can be desirable to introduce a novel restriction site in the region of the mutation in order to facilitate cleavage-based detection (Gasparini et al. (1992) Mol. Cell Probes 6:1). Amplification can be performed using Taq ligase (Barany (1991) Proc. Natl. Acad. Sci. USA 88:189). In such cases, ligation will occur only if there is a perfect match at the 3' end of the 5' sequence, thereby making it possible to assess the presence of a known mutation at a specific site by looking for the presence or absence of amplification.

The methods described herein can be performed, for example, using pre-packaged diagnostic kits comprising at least one probe nucleic acid or antibody reagent described herein. Such kits can be used, for example, in clinical settings to diagnose patients exhibiting symptoms or a family history of a disorder involving a gene encoding a polypeptide of the invention. Furthermore, any cell type or tissue in which the polypeptide of the invention is expressed (e.g., a blood sample containing peripheral blood leukocytes for proteins which are secreted or which occur on or in peripheral blood leukocytes) can be used in the prognostic assays described herein.

3. Pharmacogenomics

Agents which have a stimulatory or inhibitory effect on activity or expression of a polypeptide of the invention, as identified by a screening assay described herein for example, can be administered to individuals to treat (prophylactically or therapeutically) disorders associated with aberrant activity of the polypeptide. In conjunction with such treatment, the pharmacogenomics (i.e., the study of the relationship between an individual's genotype and that individual's response to a foreign compound or drug) of the individual can be considered. Differences in metabolism of therapeutics can lead to severe toxicity or therapeutic failure by altering the relation between dose and blood concentration of the pharmacologically active drug. Thus, the pharmacogenomics of the individual permits selection of effective agents (e.g., drugs) for prophylactic or therapeutic treatments based on a consideration of the individual's genotype. Such pharmacogenomics can further be used to determine appropriate dosages and therapeutic regimens. Accordingly, the activity of a polypeptide of the invention, expression of a nucleic acid of the invention, or mutation content of a gene of the invention in an individual can be determined to facilitate selection of one or more appropriate agents for therapeutic or prophylactic treatment of the individual.

Pharmacogenomics deals with clinically significant hereditary variations in the response to drugs due to altered drug disposition and abnormal action in affected persons. See, e.g., Linder (1997) Clin. Chem. 43(2):254-266. In general, two types of pharmacogenetic conditions can be differentiated. Genetic conditions transmitted as a single factor altering the way drugs act on the body are referred to as "altered drug action." Genetic conditions transmitted as single factors altering the way the body acts on drugs are referred to as "altered drug metabolism". These pharmacogenetic conditions can occur either as rare defects or as polymorphisms. For example, glucose-6-phosphate dehydrogenase (G6PD) deficiency is a common inherited enzymopathy in which the main clinical complication is hemolysis after ingestion of oxidant drugs (anti-malarials, sulfonamides, analgesics, nitrofurans) and consumption of fava beans.

As an illustrative embodiment, the activity of drug metabolizing enzymes is a major determinant of both the intensity and duration of drug action. The discovery of genetic polymorphisms of drug metabolizing enzymes (e.g., N-acetyltransferase 2 {NAT 2} and cytochrome P450 enzymes CYP2D6 and CYP2C19) explains why some patients do not obtain the expected drug effects or exhibit exaggerated drug response and serious toxicity following administration of standard and safe doses of a drug. These polymorphisms are expressed in two phenotypes in the population, the extensive metabolizer (EM) and poor metabolizer (PM). The prevalence of PM is different among different populations. For example, the gene encoding CYP2D6 is highly polymorphic, and several mutations have been identified in PM. Each of these mutations results in absence of functional CYP2D6. Poor metabolizers of CYP2D6 and CYP2C19 frequently experience exaggerated drug response and side effects when they receive standard doses. If a metabolite is the active therapeutic moiety, a PM will show no therapeutic response, as demonstrated for the analgesic effect of codeine mediated by its CYP2D6-formed metabolite morphine. At the other extreme are the so called ultra-rapid metabolizers who do not respond to standard doses. Recently, the molecular basis of ultra-rapid metabolism has been identified to be due to CYP2D6 gene amplification.

Thus, activity of a polypeptide of the invention, expression of a nucleic acid encoding the polypeptide, or mutation content of a gene encoding the polypeptide in an individual can be determined to facilitate selection of appropriate agents for therapeutic or prophylactic treatment of the individual. In addition, pharmacogenetic studies can be used to apply genotyping of polymorphic alleles encoding drug-metabolizing enzymes to identification of an individual's drug responsiveness phenotype. This knowledge, when applied to dosing or drug selection, can avoid adverse reactions or therapeutic failure and thus enhance therapeutic or prophylactic efficiency when treating a subject with a modulator of activity or expression of the polypeptide, such as a modulator identified by one of the examples of screening assays described herein.

4. Monitoring of Effects During Clinical Trials

Monitoring the influence of agents (e.g., drug compounds) on expression or activity of a polypeptide of the invention (e.g., ability to modulate aberrant cell proliferation chemotaxis, differentiation, or both) can be applied not only in basic drug screening, but also in clinical trials. For example, the effectiveness of an agent, as determined by a screening assay as described herein, to increase gene expression, protein levels, or protein activity can be monitored in clinical trials of subjects exhibiting decreased gene expression, protein levels, or protein activity. Alternatively, the effectiveness of an agent, as determined by a screening assay, to decrease gene expression, protein levels, or protein activity can be monitored in clinical trials of subjects exhibiting increased gene expression, protein levels, or protein activity. In such clinical trials, expression or activity of a polypeptide of the invention and, optionally, that of other polypeptide that have been implicated in similar disorders, can be used as a marker of the immune responsiveness of a particular cell.

For example, genes (including those of the invention) that are modulated in cells by treatment with an agent (e.g., a peptide, a drug, or another small molecule) which modulates activity or expression of a polypeptide of the invention (e.g., as identified in a screening assay described herein) can be identified. Thus, to study the effect of agents on cellular proliferation disorders, for example, in a clinical trial, cells can be isolated and their RNA can be prepared and analyzed to determine the level of expression of one or more genes of the invention and, optionally, other genes implicated in the disorder. The levels of gene expression (i.e., a gene expression pattern) can be quantified by Northern blot analysis or by RT-PCR, as described herein, or by assessing the amount of protein produced, by one of the methods as described herein, or by measuring the level of activity of a gene of the invention or other gene(s). In this way, the gene expression pattern can serve as an indicator of the physiological response of the cells to the agent. Accordingly, this response state can be determined before, and at various points during, or after treatment of the individual with the agent (or, of course, at more than one of these stages).

In one embodiment, the present invention provides a method for monitoring the effectiveness of treatment of a subject with an agent (e.g., an agonist, antagonist, peptidomimetic, protein, peptide, nucleic acid, small molecule, or other drug candidate identified by the screening assays described herein) comprising (i) obtaining a pre-administration sample from a subject prior to administration of the agent; (ii) detecting the level of the polypeptide or nucleic acid of the invention in the pre-administration sample; (iii)

obtaining one or more post-administration samples from the subject; (iv) detecting the level the of the polypeptide or nucleic acid of the invention in the post-administration sample(s); (v) comparing the level of the polypeptide or nucleic acid of the invention in the pre-administration sample with the level of the polypeptide or nucleic acid of the invention in the post-administration sample(s); and (vi) altering the administration of the agent to the subject accordingly. For example, increased administration of the agent can be desirable to increase the expression or activity of the polypeptide to levels higher than those detected, i.e., to increase the effectiveness of the agent. Alternatively, decreased administration of the agent can be desirable to decrease expression or activity of the polypeptide to levels lower than those detected, i.e., to decrease the effectiveness of the agent.

C. Methods of Treatment

The present invention provides both prophylactic and therapeutic methods of treating a subject afflicted with, at risk for developing, or susceptible to a disorder associated with aberrant expression or activity of a polypeptide of the invention. Such disorders are described elsewhere in this disclosure.

1. Prophylactic Methods

In one aspect, the invention provides a method for preventing in a subject, a disorder associated with aberrant expression or activity of a polypeptide of the invention, by administering to the subject an agent which modulates expression of the polypeptide or at least one activity of the polypeptide. Subjects at risk for a disease which is caused or contributed to by aberrant expression or activity of a polypeptide of the invention can be identified by, for example, any one or combination of the diagnostic and prognostic assays described herein. Administration of a prophylactic agent can occur prior to the manifestation of symptoms characteristic of the aberrance, so that the disease or disorder is prevented or, alternatively, delayed in its onset or progression. Depending on the type of aberrance, for example, an agonist or antagonist agent can be used for treating the subject. The appropriate agent can be determined based on screening assays described herein.

2. Therapeutic Methods

Another aspect of the invention pertains to methods of modulating expression or activity of a polypeptide of the invention for therapeutic purposes. The modulatory method of the invention involves contacting a cell with an agent that modulates one or more of the activities of the polypeptide. An agent that modulates activity can be an agent as described herein, such as a nucleic acid, or a protein, a naturally-occurring cognate ligand of the polypeptide, a peptide, a peptidomimetic, or a small molecule. In one embodiment, the agent stimulates one or more of the biological activities of the polypeptide. Examples of such stimulatory agents include a polypeptide of the invention, a biologically active portion of such a polypeptide, a portion of such a polypeptide which comprises an epitope of the native polypeptide, and a nucleic acid molecule encoding the polypeptide of the invention that has been introduced into the cell. In another embodiment, the agent inhibits a biological activity of the polypeptide of the invention or expression of a protein or nucleic acid of the invention. Examples of such inhibitory agents include antisense nucleic acid molecules and antibodies. These modulatory methods can be performed in vitro (e.g., by culturing the cell with the agent) or, alternatively, in vivo (e.g., by administering the agent to a subject). As such, the present invention provides methods of treating an individual afflicted with a disease or disorder characterized by aberrant expression or activity of a polypeptide of the invention. In one embodiment, the method involves administering an agent (e.g., an agent identified by a screening assay described herein), or combination of agents that modulates expression or activity (e.g., up-regulates or down-regulates) expression or activity. In another embodiment, the method involves administering a polypeptide of the invention or a nucleic acid molecule of the invention as therapy to compensate or substitute for reduced or aberrant expression or activity of the polypeptide.

Stimulation of activity is desirable in situations in which activity or expression is abnormally low or in which increased activity is likely to have a beneficial effect. Conversely, inhibition of activity is desirable in situations in which activity or expression is abnormally high or in which decreased activity is likely to have a beneficial effect.

The contents of all references, patents, and published patent applications cited in this disclosure are hereby incorporated by reference.

Deposits of Clones

Clones containing one or more cDNA molecules encoding polypeptides of the invention have been deposited with the American Type Culture Collection (ATCC®; 10801 University Boulevard, Manassas, Va. 20110-2209) on dates disclosed herein, and these deposits were assigned the Accession Numbers disclosed herein. These deposits will be maintained under the terms of the Budapest Treaty on the International Recognition of the Deposit of Microorganisms for the Purposes of Patent Procedure. These deposits were made merely as a convenience for those of skill in the art and are not an admission that any deposit is required in order to comply with 35 U.S.C. §112.

Where a clone containing multiple cDNA molecules was deposited, the following standard digest procedure can be used to liberate fragments corresponding to individual cDNA molecules, except as otherwise described. To isolate the cDNA clone, an aliquot of the deposited clone can be streaked out to yield single colonies on nutrient medium (e.g., Luria broth plates) supplemented with 100 micrograms per milliliter ampicillin. Single colonies are grown, and plasmid DNA is extracted from single colonies using a standard mini-preparation procedure. Next, a sample of the DNA mini-preparation is digested using a combination of the restriction enzymes Sal I and Not I, and the resulting products are resolved on a 0.8% (w/v) agarose gel using standard DNA electrophoresis conditions.

A clone containing a cDNA molecule encoding TANGO 416 (clone EpT416), was deposited with the American Type Culture Collection (ATCC®; 10801 University Boulevard, Manassas, Va. 20110-2209) on Apr. 26, 1999 as Accession Number PTA-1764, as an *Escherichia coli* strain carrying a recombinant plasmid harboring the clone. The standard digest procedure liberates a fragment as follows:

TANGO 416 (EpT416): 5.1 kilobases.

The identity of the strain containing TANGO 416 can be inferred from the liberation of a fragment of the above identified size.

A clone containing a cDNA molecule encoding TANGO 457 (clone 457), was deposited with the ATCC® on Oct. 1, 1999 as Accession Number PTA-817, as part of a composite deposit representing a mixture of four strains, each carrying one recombinant plasmid harboring a particular cDNA clone. The standard digest procedure liberates a fragment as follows:

TANGO 457 (457): 2.3 kilobases

The identity of the strain containing TANGO 457 can be inferred from the liberation of a fragment of the above identified size.

Clones containing cDNA molecules encoding TANGO 229 and INTERCEPT 289 (clones EpT229 and EpI289, respectively), were deposited with the ATCC® on Oct. 1, 1999 as Accession No. PTA-295, as part of a composite deposit representing a mixture of four strains, each carrying one recombinant plasmid harboring a particular cDNA clone. The standard digest procedure liberates fragments as follows:
    TANGO 229 (EpT229): 3.6 kilobases
    INTERCEPT 289 (EpI289): 1.9 kilobases The identity of the strains can be inferred from the fragments liberated.

Clones containing cDNA molecules encoding INTERCEPT 429 (clone EpI429), were deposited with the ATCC® on Aug. 5, 1999 as Accession No. PTA-455, as part of a composite deposit representing a mixture of three strains, each carrying one recombinant plasmid harboring a particular cDNA clone. The standard digest procedure liberates a fragment as follows:
    INTERCEPT 429 (EpI429): 0.5 kilobase The identity of the strain containing INTERCEPT 429 can be inferred from the liberation of a fragment of the above identified size.

Clones containing cDNA molecules encoding INTERCEPT 309 and MANGO 419 (clones EpT309 and EpT419, respectively), were deposited with the ATCC® on Jan. 6, 2000 as Accession Number PTA-1156, as part of a composite deposit representing a mixture of four strains, each carrying one recombinant plasmid harboring a particular cDNA clone. The standard digest procedure liberates fragments as follows:
    TANGO 309 (EpT309): 1.9 kilobases
    MANGO 419 (EpT419): 0.3 kilobases The identity of the strains can be inferred from the fragments liberated.

Clones containing cDNA molecules encoding TANGO 366 and INTERCEPT 394 (clones Aped and 394, respectively), were deposited with the ATCC® on Jul. 23, 1999 as Accession No. PTA-424, as part of a composite deposit representing a mixture of five strains, each carrying one recombinant plasmid harboring a particular cDNA clone. The standard digest procedure liberates fragments as follows:
    TANGO 366 (EpT366): 2.6 kilobase pairs
    INTERCEPT 394 (394): 3.7 kilobase pairs The identity of the strains can be inferred from the fragments liberated.

Clones containing cDNA molecules encoding TANGO 210 and INTERCEPT 400 (clones Aped and 400, respectively), were deposited with the ATCC® on Jul. 29, 1999 as Accession No. PTA-438, as part of a composite deposit representing a mixture of five strains, each carrying one recombinant plasmid harboring a particular cDNA clone. The standard digest procedure liberates fragments as follows:
    TANGO 210 (EpT210): 1.7 kilobase pairs
    INTERCEPT 400 (400): 3.0 kilobase pairs The identity of the strains can be inferred from the fragments liberated.

Clones comprising cDNA molecules encoding human INTERCEPT 217, human INTERCEPT 297, and human TANGO 331 were deposited with ATCC® on May 28, 1999, as part of a composite deposit representing a mixture of five strains, each carrying one recombinant plasmid harboring a particular cDNA clone. This deposit was assigned Accession Number PTA-147. The standard digest procedure (except that restriction enzymes SalI, NotI, and SmaI are used) liberates fragments as follows:
    1. human INTERCEPT 217 (clone EpT217): 2.9 kilobases
    2. human INTERCEPT 297 (clone EpT297): 1.2 kilobases and 0.3 kilobases (human INTERCEPT 297 has a SmaI cut site at about base pair 1183).
    3. human TANGO 331 (clone EpT331): 1.4 kilobases The identity of the strains can be inferred from the fragments liberated.

Human TANGO 276, human TANGO 292, human TANGO 332, human TANGO 202, human TANGO 234, and human TANGO 265 were each deposited as single deposits. Their clone names, deposit dates, and accession numbers are as follows:
    1. human TANGO 276: clone EpT276 was deposited with ATCC® on May 28, 1999, and was assigned Accession Number PTA-150.
    2. human TANGO 292: clone EpT292 was deposited with ATCC® on Apr. 28, 1999, and was assigned Accession Number 207230.
    3. human TANGO 332: clone EpT332 was deposited with ATCC® on May 28, 1999, and was assigned Accession Number PTA-151.
    4. human TANGO 202: clone EpT202 was deposited with ATCC® on Apr. 21, 1999, and was assigned Accession Number 207219.
    5. human TANGO 234: clone EpT234 was deposited with ATCC® on Apr. 2, 1999, and was assigned Accession Number 207184.
    6. human TANGO 265: clone EpT265 was deposited with ATCC® on Apr. 28, 1999, and was assigned Accession Number 207228.

Clones containing cDNA molecules encoding human TANGO 286, human TANGO 294, and INTERCEPT 296 were deposited with ATCC® on Apr. 21, 1999 as Accession Number 207220, as part of a composite deposit representing a mixture of five strains, each carrying one recombinant plasmid harboring a particular cDNA clone. The standard digest procedure (except that restriction enzymes SalI, NotI, and DraII are used) liberates fragments as follows:
    1. human TANGO 286 (clone EpT286): 1.85 kilobases and 1 kilobases (human TANGO 286 has a DraII cut site at about base pair 1856).
    2. human TANGO 294 (clone EpT294): 1.4 kilobases and 0.6 kilobases (human TANGO 294 has a DraII cut site at about base pair 1447).
    3. human INTERCEPT 296 (clone EpT296): 0.4 kilobases, 1.6 kilobases, and 0.1 kilobases (human INTERCEPT 296 has DraII cut sites at about base pair 410 and at about base pair 1933).

The identity of the strains can be inferred from the fragments liberated.

A clone containing a cDNA molecule encoding mouse TANGO 202 was deposited with ATCC® on Apr. 21, 1999 and was assigned Accession Number 207221, as part of a composite deposit representing a mixture of five strains, each carrying one recombinant plasmid harboring a particular cDNA clone. The standard digest procedure (except that restriction enzymes SalI, NotI, and ApaI are used) liberates a fragment as follows:
    mouse TANGO 202 (clone EpTm202): 3.5 kilobases and 1.4 kilobases (mouse
    TANGO 202 has a Apa I cut site at about base pair 3519).

The identity of the strain can be inferred from the fragment liberated.

SEQUENCE LISTING (460 sequences)

SEQ ID NO: 1 - DNA, 5121 bp, Homo sapiens
gtttagtctgcagccgagcagctaaagggagaaagaatcgctcaggaaagacacactgcagactccaccggcaccctgcaatagatgggttccgactacacaagggagaaaacgcggaggtgacactctcctgcctggaaagaggacgaacgaccaaacaaacgcaaggactggactccatgccgaaggtatctggaagtcgtgacacggtgtgtataaaacaaaagtttgcgagctgttaattgctgtgctgtgttattaagagacgctttcaagtttcaagtaccaaatgtagctttacgttgccaaaggaagttgaggcaattgctttgctgttttaacttgctctgtgagggaaatctcataaactgaccaatgcaccaaatgaatgctaaaatgcactttaggtttgtttttgcacttctgatagtatctttcaaccacgatgtactgggcaagaatttgaaatacaggatttatgaggaacagagggttggatcagtaattgcaagactatcagaggatgtggctgatgttttattgaagcttcctaatccttctactgttcgatttcgagccatgcagaggggaaattctcctctacttgtagtaaacgaggataatggggaaatcagcataggggctacaattgaccgtgaacaactgtgccagaaaaacttgaactgttccatagagtttgatgtgatcactctacccacagagcatctgcagcttttccatattgaagttgaagtgctggatattaatgacaattctccccagttttcaagatctctcatacctattgagatatctgagagtgcagcagttgggactcgcattcccctggacagtgcatttgatccagatgttggggaaaattccctccacacatactcgctctctgccaatgatttttttaatatcgaggttcggaccaggactgatggagccaagtatgcagaactcatagtggtcagagagttagatcgggagctgaagtcaagctacgagcttcagctcactgcctcagacatgggagtacctcagaggtctggctcatccatactaaaaataagcatttcagactccaatgacaacagccctgcttttgagcagcaatcttatataatacaactcttagaaaactccccggttggcactttgctcttagatctgaatgccacggatccagatgagggcgctaatgggaaaattgtatattccttcagcagtcatgtgtctcccaaaattatggagacttttaaaattgattctgaaagaggacatttgactcttttcaagcaagtggattatgaaatcaccaaatcctatgagattgatgttcaggctcaagatttgggtccaaattcaatcccagcccattgcaaaattataattaaggttgtggatgttaatgacaataaacctgaaattaacatcaacctcatgtcccctggaaaagaagaaatatcttatatttttgaaggggatcctattgatacatttgttgctttggtcagagttcaggacaaggattctgggctgaatggagaaatagtttgtaagcttcatggacatggtcactttaaacttcagaagacatatgaaaacaattatttaatcttaactaatgccacactggatagagaaaagagatctgagtatagtttgactgtaatcgctgaggacagggggacacccagtctctctacagtgaaacattttacagttcaaatcaatgatatcaatgacaatccaccccacttccagagaagccgatatgaatttgtaatttcagaaaataactcaccaggggcatatatcaccactgttacagccacagatcctgatcttggagaaaatgggcaagtgacatacaccatcttggagagttttattctaggaagttccataactacatatgtaaccattgacccatctaatggagccatctatgccctcagaatctttgatcatgaagaagtgagtcagatcacttttgtggtagaagcaagagatggaggaagcccgaagcaactggtaagcaataccacagttgtgctcaccatcattgacgaaaatgacaacgttcctgtggttatagggcctgcattgcgtaataatacggcagaaatcaccattcccaaaggggctgaaagtggctttcatgtcacaagaataagggcaattgacagagactctggtgtgaatgctgaactcagctgcgccatagtagcaggtaatgaggagaatatcttcataattgatccacgatcatgtgacatccataccaacgttagcatggattctgttccctacacagaatgggagctgtcagttatcattcaggacaaaggcaatcctcagctacataccaaagtccttctgaagtgcatgatctttgaatatgcagagtcggtgacaagtacagcaatgacttcagtaagccaggcatccttggatgtctccatgataataattatttccttaggagcaatttgtgcagtgttgctggttattatggtgctatttgcaactaggtgtaaccgcgagaagaaagacactagatcctataactgcagggtggccgaatcaacttaccagcaccacccaaaaaggccatcccggcagattcacaaaggggacatcacattggtgcctaccataaatggcactctgcccatcagatctcatcacagatcgtctccatcttcatctcctaccttagaaagagggcagatgggcagccggcagagtcacaacagtcaccagtcactcaacagtttggtgacaatctcatcaaaccacgtgccagagaatttctcattagaactcacccacgccactcctgctgttgagcaggtctctcagcttctttcaatgcttcaccaggggcaatatcagccaagaccaagttttcgaggaaacaaatattccaggagctacagatatgcccttcaagacatggacaaatttagcttgaaagacagtggccgtggtgacagtgaggcaggagacagtgattatgatttggggcgagattctccaatagataggctgctgggtgaaggattcagcgacctgtttctcacagatggaagaattccagcagctatgagactctgcacggaggagtgcagggtcctgggacactctgaccagtgctggatgccaccactgccctcaccgtcttctgattataggagtaacatgttcattccaggggaagaattcccaacgcaaccccagcagcagcatccacatcagagtcttgaggatgacgctcagcctgcagattccggtgaaaagaagaagagtttttccacctttggaaaggactccccaaacgatgaggacactggggataccagcacatcatctctgctctcggaaatgagcagtgtgttccagcgtctcttaccgccttccctggacacctattctgaatgcagtgaggtggatcggtccaactccctggagcgcaggaagggacccttgccagccaaaactgtgggttacccacagggggtagcggcatgggcagccagtacgcattttcaaaatcccaccaccaactgtgggccgccacttggaactcactccagtgtgcagccttcttcaaaatggctgccagccatggaggagatccctgaaaattatgaggaagatgattttgacaatgtgctcaaccacctcaatgatgggaaacacgaactcatggatgccagtgaactggtggcagagattaacaaactgcttcaagatgtccgccagagctaggagattttagcgaagcatttttgtttccatgtatatggaaatagggaacaacaacaacaacaaaaaaccctgaaagaactggcattgccaaatagttgcatttatcataaatgtgtctgtgtatattgaatattaaatactgtattttcgtatgtacacaatgcaagtgtgattattttaatctgtattttaaaaatacatttgtaccttatatttatgtgtaatttaacaaacaaattttatttttttactcccatgacagacatgtttttcctagtcgtgtagaaactagccactgttcaaatctgatacactattcaaccacaaagtgtaaaggcactgcttagattagttttgttggggaagaattattatgttgtatgaacaaccccactgaagcattatacaattcttaattccattaagtgatcccactttttttcaataactttttagaaattaagaatcattaaaattgttaagctattttattgttattttctctactttctactagccccaatagttgaactcttataggaaaatcgaaagataaagtgaaagtttatttcaggactgagaaatatcttgaaggttatttattagatgactatctcaaatgaactttttatagacaatgatgaaaacagaactaaagtcaatgtttcctgactcccaggcccctactattccaggccatcacactggcctgttccggagaatatttctctcacaatattattatctacttataattatggtaaacaataaattttattccatccttgtagtatgaaacatgctccaaggaaatggaatctgtcctttaaatggataacagtatgtgttctaatggcataaaatattactggataaaaacagttgtgtcagtgtctctcctaaggtagtaaatataattgacttattctgaacccattctattttgaatctcccctttcctctcacaatacttgaacattttaatcttttggaatattgtctttctttgttataactattcatttttagcttttgtctccagtgcatgatctcatatttttgcttttatttttagtataagaacatttataaaatcatatttttgttactgcaattgttttatttgttgtgtggcaaatgagaaatcctttatttattgtgctgtgatctctctgtgtggaatgccttggtgagagagatgcttattatgactattatcatttctgaccaagcttctattaatgttatttctaataatacactatcttgattgtactctccagaaaatttttctgtcagtgaaaataaaagaaaaattaaagtaaaaaaaaaaaaaaa

SEQ ID NO: 2 - DNA, 3405 bp, Homo sapiens
atgcaccaaatgaatgctaaaatgcactttaggtttgtttttgcacttctgatagtatctttcaaccacgatgtactgggcaagaatttgaaatacaggatttatgaggaacagagggttggatcagtaattgcaagactatcagaggatgtggctgatgttttattgaagcttcctaatccttctactgttcgatttcgagccatgcagaggggaaattctcctctacttgtagtaaacgaggataatggggaaatcagcataggggctacaattgaccgtgaacaactgtgccagaaaaacttgaactgttccatagagtttgatgtgatcactctacccacagagcatctgcagcttttccatattgaagttgaagtgctggatattaatgacaattctccccagttttcaagatctctcatacctattgagatatctgagagtgcagcagttgggactcgcattcccctggacagtgcatttgatccagatgttggggaaaattccctccacacatactcgctctctgccaatgatttttttaatatcgaggttcggaccaggactgatggagccaagtatgcagaactcatagtggtcagagagttagatcgggagctgaagtcaagctacgagcttcagctcactgcctcagacatgggagtacctcagaggtctggctcatccatactaaaaataagcatttcagactccaatgacaacagccctgcttttgagcagcaatcttatataatacaactcttagaaaactccccggttggcactttgctcttagatctgaatgccacggatccagatgagggcgctaatgggaaaattgtatattccttcagcagtcatgtgtctcccaaaattatggagacttttaaaattgattctgaaagaggacatttgactcttttcaagcaagtggattatgaaatcaccaaatcctatgagattgatgttcaggctcaagatttgggtccaaattcaatcccagcccattgcaaaattataattaaggttgtggatgttaatgacaataaacctgaaattaacatcaacctcatgtcccctggaaaagaagaaatatcttatatttttgaaggggatcctattgatacatttgttgctttggtcagagttcaggacaaggattctgggctgaatggagaaatagtttgtaagcttcatggacatggtcactttaaacttcagaagacatatgaaaacaattatttaatcttaactaatgccacactggatagagaaaagagatctgagtatagtttgactgtaatcgctgaggacagggggacacccagtctctctacagtgaaacattttacagttcaaatcaatgatatcaatgacaatccaccccacttccagagaagccgatatgaatttgtaatttcagaaaataactcaccaggggcatatatcaccactgttacagccacagatcctgatcttggagaaaatgggcaagtgacatacaccatcttggagagttttattctaggaagttccataactacatatgtaaccattgacccatctaatggagccatctatgccctcagaatctttgatcatgaagaagtgagtcagatcacttttgtggtagaagcaagagatggaggaagcccgaagcaactggtaagcaataccacagttgtgctcaccatcattgacgaaaatgacaacgttcctgtggttatagggcctgcattgcgtaataatacggcagaaatcaccattcccaaaggggctgaaagtggctttcatgtcacaagaataagggcaattgacagagactctggtgtgaatgctgaactcagctgcgccatagtagcaggtaatgaggagaatatcttcataattgatccacgatcatgtgacatccataccaacgttagcatggattctgttccctacacagaatgggagctgtcagttatcattcaggacaaaggcaatcctcagctacataccaaagtccttctgaagtgcatgatctttgaatatgcagagtcggtgacaagtacagcaatgacttcagtaagccaggcatccttggatgtctccatgataataattatttccttaggagcaatttgtgcagtgttgctggttattatggtgctatttgcaactaggtgtaaccgcgagaagaaagacactagatcctataactgcagggtggccgaatcaacttaccagcaccacccaaaaaggccatcccggcagattcacaaaggggacatcacattggtgcctaccataaatggcactctgcccatcagatctcatcacagatcgtctccatcttcatctcctaccttagaaagagggcagatgggcagccggcagagtcacaacagtcaccagtcactcaacagtttggtgacaatctcatcaaaccacgtgccagagaatttctcattagaactcacccacgccactcctgctgttgagcaggtctctcagcttctttcaatgcttcaccaggggcaatatcagccaagaccaagttttcgaggaaacaaatattccaggagctacagatatgcccttcaagacatggacaaatttagcttgaaagacagtggccgtggtgacagtgaggcaggagacagtgattatgatttggggcgagattctccaatagataggctgctgggtgaaggattcagcgacctgtttctcacagatggaagaattccagcagctatgagactctgcacggaggagtgcagggtcctgggacactctgaccagtgctggatgccaccactgccctcaccgtcttctgattataggagtaacatgttcattccaggggaagaattcccaacgcaaccccagcagcagcatccacatcagagtcttgaggatgacgctcagcctgcagattccggtgaaaagaagaagagtttttccacctttggaaaggactccccaaacgatgaggacactggggataccagcacatcatctctgctctcggaaatgagcagtgtgttccagcgtctcttaccgccttccctggacacctattctgaatgcagtgaggtggatcggtccaactccctggagcgcaggaagggacccttgccagccaaaactgtgggttacccacagggggtagcggcatgggcagccagtacgcattttcaaaatcccaccaccaactgtgggccgccacttggaactcactccagtgtgcagccttcttcaaaatggctgccagccatggaggagatccctgaaaattatgaggaagatgattttgacaatgtgctcaaccacctcaatgatgggaaacacgaactcatggatgccagtgaactggtggcagagattaacaaactgcttcaagatgtccgccagagc

SEQ ID NO: 3 - protein, 911 aa, Homo sapiens
MHQMNAKMHFRFVFALLIVSFNHDVLGKNLKYRIYEEQRVGSVIARLSEDVADVLLKLPNPSTVRFRAMQRGNSPLLVVNEDNGEISIGATIDREQTLPTEHLQLFHIEVEVLDINDNSPQFSRSLIPIEISESAAVGTRIPLDSAFDPDVGENSLHTYSLSANDFFNIEVRTRTDELKSSYELQLTASDMGVPQRSGSSILKISISDSNDNSPAFEQQSYIIQLLENSPVGTLLLDLNATDPDEGANGKIVYSFSSHVSPKIMETFKIDSEKSYEIDVQAQDLGPNSIPAHCKIIIKVVDVNDNKPEININLMSPGKEEISYIFEGDPIDTFVALVRVQDKDSGLNGEIVCNNYLILTNATLDREKRSEYSLTVIAEDRGTPSLSTVKHFTVQINDINDNPPHFQRSRYEFVISENNSPGAYITTVTATDPFILGSSITTYVTIDPSNGAIYALRIFDHEEVSQITFVVEARDGGSPKQLVSNTTVVLTIIDENDNVPVVIGPALRNNTAEITIPKGAESGFHVTRIAIVAGNEENIFIIDPRSCDIHTNVSMDSVPYTEWELSVIIQDKGNPQLHTKVLLKCMIFEYAESVTSTAMTSVSQASLDVLVIMVLFATRCNREKKDTRSYNCRVAESTYQHHPKRPSRQIHKGDITLVPTINGTLPIRSHHRSSPSSSPTLERGQMGSRSSNHVPENFSLELTHATPAVEQVSQLLSMLHQGQYQPRPSFRGNKYSRSYRYALQDMDKFSLKDSGRGDSEAGDSDYDLGRDSPIDRLLGEGFSDLEECRVLGHSDQCWMPPLPSPSSDYRSNMFIPGEEFPTQPQQQHPHQSLEDDAQPADSGEKKKSFSTFGKDSPNDEDTGDTVDRSNSLERRKGPLPAEEIPENYEEDDFDNVLLVAEINKLLQDVRQS

SEQ ID NO: 4 - protein, 27 aa, Homo sapiens
MHQMNAKMHFRFVFALLIVSFNHDVLG

SEQ ID NO: 5 - protein, 1108 aa, Homo sapiens
KNLKYRIYEEQRVGSVIARLSEDVADVLLKLPNPSTVRFRAMQRGNSPLLVVNEDNGEISIGATIDREQLCQKNLNCSIEFDVITLPTEHLQLFHIEVEVLDINDNSPQFSRSLIPIEISESAAVGTRIPLDSAFDPDVGENSLHTYSLSANDFFNIEVRTRTDGAKYAELIVVRELDRELKSSYELQLTASDMGVPQRSGSSILKISISDSNDNSPAFEQQSYIIQLLENSPVGTLLLDLNATDPDEGANGKIVYSFSSHVSPKIMETFKIDSERGHLTLFKQVDYEITKSYEIDVQAQDLGPNSIPAHCKIIIKVVDVNDNKPEININLMSPGKEEISYIFEGDPIDTFVALVRVQDKDSGLNGEIVCKLHGHGHFKLQKTYENNYLILTNATLDREKRSEYSLTVIAEDRGTPSLSTVKHFTVQINDINDNPPHFQRSRYEFVISENNSPGAYITTVTATDPDLGENGQVTYTILESFILGSSITTYVTIDPSNGAIYALRIFDHEEVSQITFVVEARDGGSPKQLVSNTTVVLTIIDENDNVPVVIGPALRNNTAEITIPKGAESGFHVTRIRAIDRDSGVNAELSCAIVAGNEENIFIIDPRSCDIHTNVSMDSVPYTEWELSVIIQDKGNPQLHTKVLLKCMIFEYAESVTSTAMTSVSQASLDVSMIIIISLGAICAVLLVIMVLFATRCNREKKDTRSYNCRVAESTYQHHPKRPSRQIHKGDITLVPTINGTLPIRSHHRSSPSSSPTLERGQMGSRQSHNSHQSLNSLVTISSNHVPENFSLELTHATPAVEQVSQLLSMLHQGQYQPRPSFRGNKYSRSYRYALQDMDKFSLKDSGRGDSEAGDSDYDLGRDSPIDRLLGEGFSDLFLTDGRIPAAMRLCTEECRVLGHSDQCWMPPLPSPSSDYRSNMFIPGEEFPTQPQQQHPHQSLEDDAQPADSGEKKKSFSTFGKDSPNDEDTGDTSTSSLLSEMSSVFQRLLPPSLDTYSECSEVDRSNSLERRKGPLPAKTVGYPQGVAAWAASTHFQNPTTNCGPPLGTHSSVQPSSKWLPAMEEIPENYEEDDFDNVLNHLNDGKHELMDASELVAEINKLLQDVRQS

SEQ ID NO: 6 - protein, 673 aa, Homo sapiens
KNLKYRIYEEQRVGSVIARLSEDVADVLLKLPNPSTVRFRAMQRGNSPLLVVNEDNGEISIGATIDREQLCQKNLNCSIEFDVITLPTEHLQLFHIEVEVLDINDNSPQFSRSLIPIEISESAAVGTRIPLDSAFDPDVGENSLHTYSLSANDFFNIEVRTRTDGAKYAELIVVRELDRELKSSYELQLTASDMGVPQRSGSSILKISISDSNDNSPAFEQQSYIIQLLENSPVGTLLLDLNATDPDEGANGKIVYSFSSHVSPKIMETFKIDSERGHLTLFKQVDYEITKSYEIDVQAQDLGPNSIPAHCKIIIKVVDVNDNKPEININLMSPGKEEISYIFEGDPIDTFVALVRVQDKDSGLNGEIVCKLHGHGHFKLQKTYENNYLILTNATLDREKRSEYSLTVIAEDRGTPSLSTVKHFTVQINDINDNPPHFQRSRYEFVISENNSPGAYITTVTATDPDLGENGQVTYTILESFILGSSITTYVTIDPSNGAIYALRIFDHEEVSQITFVVEARDGGSPKQLVSNTTVVLTIIDENDNVPVVIGPALRNNTAEITIPKGAESGFHVTRIRAIDRDSGVNAELSCAIVAGNEENIFIIDPRSCDIHTNVSMDSVPYTEWELSVIIQDKGNPQLHTKVLLKCMIFEYAESVTSTAMTSVSQASLDVSM

SEQ ID NO: 7 - protein, 21 aa, Homo sapiens
IIIISLGAICAVLLVIMVLFA

SEQ ID NO: 8 - protein, 414 aa, Homo sapiens
TRCNREKKDTRSYNCRVAESTYQHHPKRPSRQIHKGDITLVPTINGTLPIRSHHRSSPSSSPTLERGQMGSRQSHNSHQSLNSLVTISSNHVPENFSLELTHATPAVEQVSQLLSMLHQGQYQPRPSFRGNKYSRSYRYALQDMDKFSLKDSGRGDSEAGDSDYDLGRDSPIDRLLGEGFSDLFLTDGRIPAAMRLCTEECRVLGHSDQCWMPPLPSPSSDYRSNMFIPGEEFPTQPQQQHPHQSLEDDAQPADSGEKKKSFSTFGKDSPNDEDTGDTSTSSLLSEMSSVFQRLLPPSLDTYSECSEVDRSNSLERRKGPLPAKTVGYPQGVAAWAASTHFQNPTTNCGPPLGTHSSVQPSSKWLPAMEEIPENYEEDDFDNVLNHLNDGKHELMDASELVAEINKLLQDVRQS

SEQ ID NO: 9 - skipped
  Unknown

SEQ ID NO: 10 - skipped
  Unknown

SEQ ID NO: 11 - skipped
  Unknown

SEQ ID NO: 12 - skipped
  Unknown

SEQ ID NO: 13 - skipped
  Unknown

SEQ ID NO: 14 - skipped
  Unknown

SEQ ID NO: 15 - skipped
  Unknown

SEQ ID NO: 16 - skipped
  Unknown

SEQ ID NO: 17 - skipped
  Unknown

SEQ ID NO: 18 - skipped
  Unknown

SEQ ID NO: 19 - skipped
  Unknown

SEQ ID NO: 20 - skipped
  Unknown

SEQ ID NO: 21 - skipped
  Unknown

SEQ ID NO: 22 - skipped
  Unknown

SEQ ID NO: 23 - skipped
  Unknown

SEQ ID NO: 24 - skipped
  Unknown

SEQ ID NO: 25 - skipped
  Unknown

SEQ ID NO: 26 - skipped
  Unknown

SEQ ID NO: 27 - skipped
  Unknown

SEQ ID NO: 28 - skipped
  Unknown

SEQ ID NO: 29 - skipped
  Unknown

SEQ ID NO: 30 - skipped
  Unknown

SEQ ID NO: 31 - DNA, 5118 bp, Homo sapiens
gtttagtctgcagccgagcagctaaagggagaaagaatcgctcaggaaagacacactgcagactccaccggcaccctgcaatagatgggttccgactacacaagggagaaaacgcggaggtgacactctcctgcctggaaagaggacgaacgaccaaacaaacgcaaggactggactccatgccgaaggtatctggaagtcgtgacacggtgtgtataaaacaaaagtttgcgagctgttaattgctgtgctgtgttattaagagacgctttcaagtttcaagtaccaaatgtagctttacgttgccaaaggaagttgaggcaattgctttgctgttttaacttgctctgtgagggaaatctcataaactgaccaatgcaccaaatgaatgctaaaatgcactttaggtttgtttttgcacttctgatagtatctttcaaccacgatgtactgggcaagaatttgaaatacaggatttatgaggaacagagggttggatcagtaattgcaagactatcagaggatgtggctgatgttttattgaagcttcctaatccttctactgttcgatttcgagccatgcagaggggaaattctcctctacttgtagtaaacgaggataatggggaaatcagcataggggctacaattgaccgtgaacaactgtgccagaaaaacttgaactgttccatagagtttgatgtgatcactctacccacagagcatctgcagcttttccatattgaagttgaagtgctggatattaatgacaattctccccagttttcaagatctctcatacctattgagatatctgagagtgcagcagttgggactcgcattcccctggacagtgcatttgatccagatgttggggaaaattccctccacacatactcgctctctgccaatgatttttttaatatcgaggttcggaccaggactgatggagccaagtatgcagaactcatagtggtcagagagttagatcgggagctgaagtcaagctacgagcttcagctcactgcctcagacatgggagtacctcagaggtctggctcatccatactaaaaataagcatttcagactccaatgacaacagccctgcttttgagcagcaatcttatataatacaactcttagaaaactccccggttggcactttgctcttagatctgaatgccacggatccagatgagggcgctaatgggaaaattgtatattccttcagcagtcatgtgtctcccaaaattatggagacttttaaaattgattctgaaagaggacatttgactcttttcaagcaagtggattatgaaatcaccaaatcctatgagattgatgttcaggctcaagatttgggtccaaattcaatcccagcccattgcaaaattataattaaggttgtggatgttaatgacaataaacctgaaattaacatcaacctcatgtcccctggaaaagaagaaatatcttatatttttgaaggggatcctattgatacatttgttgctttggtcagagttcaggacaaggattctgggctgaatggagaaatagtttgtaagcttcatggacatggtcactttaaacttcagaagacatatgaaaacaattatttaatcttaactaatgccacactggatagagaaaagagatctgagtatagtttgactgtaatcgctgaggacagggggacacccagtctctctacagtgaaacattttacagttcaaatcaatgatatcaatgacaatccaccccacttccagagaagccgatatgaatttgtaatttcagaaaataactcaccaggggcatatatcaccactgttacagccacagatcctgatcttggagaaaatgggcaagtgacatacaccatcttggagagttttattctaggaagttccataactacatatgtaaccattgacccatctaatggagccatctatgccctcagaatctttgatcatgaagaagtgagtcagatcacttttgtggtagaagcaagagatggaggaagcccgaagcaactggtaagcaataccacagttgtgctcaccatcattgacgaaaatgacaacgttcctgtggttatagggcctgcattgcgtaataatacggcagaaatcaccattcccaaaggggctgaaagtggctttcatgtcacaagaataagggcaattgacagagactctggtgtgaatgctgaactcagctgcgccatagtagcaggtaatgaggagaatatcttcataattgatccacgatcatgtgacatccataccaacgttagcatggattctgttccctacacagaatgggagctgtcagttatcattcaggacaaaggcaatcctcagctacataccaaagtccttctgaagtgcatgatctttgaatatgcagagtcggtgacaagtacagcaatgacttcagtaagccaggcatccttggatgtctccatgataataattatttccttaggagcaatttgtgcagtgttgctggttattatggtgctatttgcaactaggtgtaaccgcgagaagaaagacactagatcctataactgcagggtggccgaatcaacttaccagcaccacccaaaaaggccatcccggcagattcacaaaggggacatcacattggtgcctaccataaatggcactctgcccatcagatctcatcacagatcgtctccatcttcatctcctaccttagaaagagggcagatgggcagccggcagagtcacaacagtcaccagtcactcaacagtttggtgacaatctcatcaaaccacgtgccagagaatttctcattagaactcacccacgccactcctgctgttgaggtctctcagcttctttcaatgcttcaccaggggcaatatcagccaagaccaagttttcgaggaaacaaatattccaggagctacagatatgcccttcaagacatggacaaatttagcttgaaagacagtggccgtggtgacagtgaggcaggagacagtgattatgatttggggcgagattctccaatagataggctgctgggtgaaggattcagcgacctgtttctcacagatggaagaattccagcagctatgagactctgcacggaggagtgcagggtcctgggacactctgaccagtgctggatgccaccactgccctcaccgtcttctgattataggagtaacatgttcattccaggggaagaattcccaacgcaaccccagcagcagcatccacatcagagtcttgaggatgacgctcagcctgcagattccggtgaaaagaagaagagtttttccacctttggaaaggactccccaaacgatgaggacactggggataccagcacatcatctctgctctcggaaatgagcagtgtgttccagcgtctcttaccgccttccctggacacctattctgaatgcagtgaggtggatcggtccaactccctggagcgcaggaagggacccttgccagccaaaactgtgggttacccacagggggtagcggcatgggcagccagtacgcattttcaaaatcccaccaccaactgtgggccgccacttggaactcactccagtgtgcagccttcttcaaaatggctgccagccatggaggagatccctgaaaattatgaggaagatgattttgacaatgtgctcaaccacctcaatgatgggaaacacgaactcatggatgccagtgaactggtggcagagattaacaaactgcttcaagatgtccgccagagctaggagattttagcgaagcatttttgtttccatgtatatggaaatagggaacaacaacaacaacaaaaaaccctgaaagaactggcattgccaaatagttgcatttatcataaatgtgtctgtgtatattgaatattaaatactgtattttcgtatgtacacaatgcaagtgtgattattttaatctgtattttaaaaatacatttgtaccttatatttatgtgtaatttaacaaacaaattttatttttttactcccatgacagacatgtttttcctagtcgtgtagaaactagccactgttcaaatctgatacactattcaaccacaaagtgtaaaggcactgcttagattagttttgttggggaagaattattatgttgtatgaacaaccccactgaagcattatacaattcttaattccattaagtgatcccactttttttcaataactttttagaaattaagaatcattaaaattgttaagctattttattgttattttctctactttctactagccccaatagttgaactcttataggaaaatcgaaagataaagtgaaagtttatttcaggactgagaaatatcttgaaggttatttattagatgactatctcaaatgaactttttatagacaatgatgaaaacagaactaaagtcaatgtttcctgactcccaggcccctactattccaggccatcacactggcctgttccggagaatatttctctcacaatattattatctacttataattatggtaaacaataaattttattccatccttgtagtatgaaacatgctccaaggaaatggaatctgtcctttaaatggataacagtatgtgttctaatggcataaaatattactggataaaaacagttgtgtcagtgtctctcctaaggtagtaaatataattgacttattctgaacccattctattttgaatctcccctttcctctcacaatacttgaacattttaatcttttggaatattgtctttctttgttataactattcatttttagcttttgtctccagtgcatgatctcatatttttgcttttatttttagtataagaacatttataaaatcatatttttgttactgcaattgttttatttgttgtgtggcaaatgagaaatcctttatttattgtgctgtgatctctctgtgtggaatgccttggtgagagagatgcttattatgactattatcatttctgaccaagcttctattaatgttatttctaataatacactatcttgattgtactctccagaaaatttttctgtcagtgaaaataaaagaaaaattaaagtaaaaaaaaaaaaaaa

SEQ ID NO: 32 - DNA, 3402 bp, Homo sapiens
atgcaccaaatgaatgctaaaatgcactttaggtttgtttttgcacttctgatagtatctttcaaccacgatgtactgggcaagaatttgaaatacaggatttatgaggaacagagggttggatcagtaattgcaagactatcagaggatgtggctgatgttttattgaagcttcctaatccttctactgttcgatttcgagccatgcagaggggaaattctcctctacttgtagtaaacgaggataatggggaaatcagcataggggctacaattgaccgtgaacaactgtgccagaaaaacttgaactgttccatagagtttgatgtgatcactctacccacagagcatctgcagcttttccatattgaagttgaagtgctggatattaatgacaattctccccagttttcaagatctctcatacctattgagatatctgagagtgcagcagttgggactcgcattcccctggacagtgcatttgatccagatgttggggaaaattccctccacacatactcgctctctgccaatgatttttttaatatcgaggttcggaccaggactgatggagccaagtatgcagaactcatagtggtcagagagttagatcgggagctgaagtcaagctacgagcttcagctcactgcctcagacatgggagtacctcagaggtctggctcatccatactaaaaataagcatttcagactccaatgacaacagccctgcttttgagcagcaatcttatataatacaactcttagaaaactccccggttggcactttgctcttagatctgaatgccacggatccagatgagggcgctaatgggaaaattgtatattccttcagcagtcatgtgtctcccaaaattatggagacttttaaaattgattctgaaagaggacatttgactcttttcaagcaagtggattatgaaatcaccaaatcctatgagattgatgttcaggctcaagatttgggtccaaattcaatcccagcccattgcaaaattataattaaggttgtggatgttaatgacaataaacctgaaattaacatcaacctcatgtcccctggaaaagaagaaatatcttatatttttgaaggggatcctattgatacatttgttgctttggtcagagttcaggacaaggattctgggctgaatggagaaatagtttgtaagcttcatggacatggtcactttaaacttcagaagacatatgaaaacaattatttaatcttaactaatgccacactggatagagaaaagagatctgagtatagtttgactgtaatcgctgaggacagggggacacccagtctctctacagtgaaacattttacagttcaaatcaatgatatcaatgacaatccaccccacttccagagaagccgatatgaatttgtaatttcagaaaataactcaccaggggcatatatcaccactgttacagccacagatcctgatcttggagaaaatgggcaagtgacatacaccatcttggagagttttattctaggaagttccataactacatatgtaaccattgacccatctaatggagccatctatgccctcagaatctttgatcatgaagaagtgagtcagatcacttttgtggtagaagcaagagatggaggaagcccgaagcaactggtaagcaataccacagttgtgctcaccatcattgacgaaaatgacaacgttcctgtggttatagggcctgcattgcgtaataatacggcagaaatcaccattcccaaaggggctgaaagtggctttcatgtcacaagaataagggcaattgacagagactctggtgtgaatgctgaactcagctgcgccatagtagcaggtaatgaggagaatatcttcataattgatccacgatcatgtgacatccataccaacgttagcatggattctgttccctacacagaatgggagctgtcagttatcattcaggacaaaggcaatcctcagctacataccaaagtccttctgaagtgcatgatctttgaatatgcagagtcggtgacaagtacagcaatgacttcagtaagccaggcatccttggatgtctccatgataataattatttccttaggagcaatttgtgcagtgttgctggttattatggtgctatttgcaactaggtgtaaccgcgagaagaaagacactagatcctataactgcagggtggccgaatcaacttaccagcaccacccaaaaaggccatcccggcagattcacaaaggggacatcacattggtgcctaccataaatggcactctgcccatcagatctcatcacagatcgtctccatcttcatctcctaccttagaaagagggcagatgggcagccggcagagtcacaacagtcaccagtcactcaacagtttggtgacaatctcatcaaaccacgtgccagagaatttctcattagaactcacccacgccactcctgctgttgaggtctctcagcttctttcaatgcttcaccaggggcaatatcagccaagaccaagttttcgaggaaacaaatattccaggagctacagatatgcccttcaagacatggacaaatttagcttgaaagacagtggccgtggtgacagtgaggcaggagacagtgattatgatttggggcgagattctccaatagataggctgctgggtgaaggattcagcgacctgtttctcacagatggaagaattccagcagctatgagactctgcacggaggagtgcagggtcctgggacactctgaccagtgctggatgccaccactgccctcaccgtcttctgattataggagtaacatgttcattccaggggaagaattcccaacgcaaccccagcagcagcatccacatcagagtcttgaggatgacgctcagcctgcagattccggtgaaaagaagaagagtttttccacctttggaaaggactccccaaacgatgaggacactggggataccagcacatcatctctgctctcggaaatgagcagtgtgttccagcgtctcttaccgccttccctggacacctattctgaatgcagtgaggtggatcggtccaactccctggagcgcaggaagggacccttgccagccaaaactgtgggttacccacagggggtagcggcatgggcagccagtacgcattttcaaaatcccaccaccaactgtgggccgccacttggaactcactccagtgtgcagccttcttcaaaatggctgccagccatggaggagatccctgaaaattatgaggaagatgattttgacaatgtgctcaaccacctcaatgatgggaaacacgaactcatggatgccagtgaactggtggcagagattaacaaactgcttcaagatgtccgccagagc

SEQ ID NO: 33 - protein, 1134 aa, Homo sapiens
MHQMNAKMHFRFVFALLIVSFNHDVLGKNLKYRIYEEQRVGSVIARLSEDVADVLLKLPNPSTVRFRAMQRGNSPLLVVNEDNGEISIGATIDREQLCQKNLNCSIEFDVITLPTEHLQLFHIEVEVLDINDNSPQFSRSLIPIEISESAAVGTRIPLDSAFDPDVGENSLHTYSLSANDFFNIEVRTRTDGAKYAELIVVRELDRELKSSYELQLTASDMGVPQRSGSSILKISISDSNDNSPAFEQQSYIIQLLENSPVGTLLLDLNATDPDEGANGKIVYSFSSHVSPKIMETFKIDSERGHLTLFKQVDYEITKSYEIDVQAQDLGPNSIPAHCKIIIKVVDVNDNKPEININLMSPGKEEISYIFEGDPIDTFVALVRVQDKDSGLNGEIVCKLHGHGHFKLQKTYENNYLILTNATLDREKRSEYSLTVIAEDRGTPSLSTVKHFTVQINDINDNPPHFQRSRYEFVISENNSPGAYITTVTATDPDLGENGQVTYTILESFILGSSITTYVTIDPSNGAIYALRIFDHEEVSQITFVVEARDGGSPKQLVSNTTVVLTIIDENDNVPVVIGPALRNNTAEITIPKGAESGFHVTRIRAIDRDSGVNAELSCAIVAGNEENIFIIDPRSCDIHTNVSMDSVPYTEWELSVIIQDKGNPQLHTKVLLKCMIFEYAESVTSTAMTSVSQASLDVSMIIIISLGAICAVLLVIMVLFATRCNREKKDTRSYNCRVAESTYQHHPKRPSRQIHKGDITLVPTINGTLPIRSHHRSSPSSSPTLERGQMGSRQSHNSHQSLNSLVTISSNHVPENFSLELTHATPAVEVSQLLSMLHQGQYQPRPSFRGNKYSRSYRYALQDMDKFSLKDSGRGDSEAGDSDYDLGRDSPIDRLLGEGFSDLFLTDGRIPAAMRLCTEECRVLGHSDQCWMPPLPSPSSDYRSNMFIPGEEFPTQPQQQHPHQSLEDDAQPADSGEKKKSFSTFGKDSPNDEDTGDTSTSSLLSEMSSVFQRLLPPSLDTYSECSEVDRSNSLERRKGPLPAKTVGYPQGVAAWAASTHFQNPTTNCGPPLGTHSSVQPSSKWLPAMEEIPENYEEDDFDNVLNHLNDGKHELMDASELVAEINKLLQDVRQS

SEQ ID NO: 34 - skipped
  Unknown

SEQ ID NO: 35 - protein, 1107 aa, Homo sapiens
KNLKYRIYEEQRVGSVIARLSEDVADVLLKLPNPSTVRFRAMQRGNSPLLVVNEDNGEISIGATIDREQLCQKNLNCSIEFDVITLPTEHLQLFHIEVEVLDINDNSPQFSRSLIPIEISESAAVGTRIPLDSAFDPDVGENSLHTYSLSANDFFNIEVRTRTDGAKYAELIVVRELDRELKSSYELQLTASDMGVPQRSGSSILKISISDSNDNSPAFEQQSYIIQLLENSPVGTLLLDLNATDPDEGANGKIVYSFSSHVSPKIMETFKIDSERGHLTLFKQVDYEITKSYEIDVQAQDLGPNSIPAHCKIIIKVVDVNDNKPEININLMSPGKEEISYIFEGDPIDTFVALVRVQDKDSGLNGEIVCKLHGHGHFKLQKTYENNYLILTNATLDREKRSEYSLTVIAEDRGTPSLSTVKHFTVQINDINDNPPHFQRSRYEFVISENNSPGAYITTVTATDPDLGENGQVTYTILESFILGSSITTYVTIDPSNGAIYALRIFDHEEVSQITFVVEARDGGSPKQLVSNTTVVLTIIDENDNVPVVIGPALRNNTAEITIPKGAESGFHVTRIRAIDRDSGVNAELSCAIVAGNEENIFIIDPRSCDIHTNVSMDSVPYTEWELSVIIQDKGNPQLHTKVLLKCMIFEYAESVTSTAMTSVSQASLDVSMIIIISLGAICAVLLVIMVLFATRCNREKKDTRSYNCRVAESTYQHHPKRPSRQIHKGDITLVPTINGTLPIRSHHRSSPSSSPTLERGQMGSRQSHNSHQSLNSLVTISSNHVPENFSLELTHATPAVEVSQLLSMLHQGQYQPRPSFRGNKYSRSYRYALQDMDKFSLKDSGRGDSEAGDSDYDLGRDSPIDRLLGEGFSDLFLTDGRIPAAMRLCTEECRVLGHSDQCWMPPLPSPSSDYRSNMFIPGEEFPTQPQQQHPHQSLEDDAQPADSGEKKKSFSTFGKDSPNDEDTGDTSTSSLLSEMSSVFQRLLPPSLDTYSECSEVDRSNSLERRKGPLPAKTVGYPQGVAAWAASTHFQNPTTNCGPPLGTHSSVQPSSKWLPAMEEIPENYEEDDFDNVLNHLNDGKHELMDASELVAEINKLLQDVRQS

SEQ ID NO: 36 - skipped
  Unknown

SEQ ID NO: 37 - skipped
  Unknown

SEQ ID NO: 38 - protein, 295 aa, Homo sapiens
ATRCNREKKDTRSYNCRVAESTYQHHPKRPSRQIHKGDITLVPTINGTLPIRSHHRSSPSSSPTLERGQMGSRQSHNSHQNFSLELTHATPAVEVSQLLSMLHQGQYQPRPSFRGNKYSRSYRYALQDMDKFSLKDSGRGDSEAGDSDYDLGRDSPIDRLPAAMRLCTEECRVLGHSDQCWMPPLPSPSSDYRSNMFIPGEEFPTQPQQQHPHQSLEDDAQPADSGEKKKSFSTFGKDSPSEMSSVFQRLLPPSLDTNCGPPLGTHSSVQPSHELMDASELVAEINKLLQDVRQS

SEQ ID NO: 39 - skipped
  Unknown

SEQ ID NO: 40 - DNA, 2338 bp, Homo sapiens
aagagatctgagtatagtttgactgtaatcgctgaggacagggggacacccagtctctctacagtgaaacattttacagttcaaatcaatgatatcaatgacaatccaccccacttccagagaagccgatatgaatttgtaatttcagaaaataactcaccaggggcatatatcaccactgttacagccacagatcctgatcttggagaaaatgggcaagtgacatacaccatcttggagagttttattctaggaagttccataactacatatgtaaccattgacccatctaatggagccatctatgccctcagaatctttgatcatgaagaagtgagtcagatcacttttgtggtagaagcaagagatggaggaagcccgaagcaactggtaagcaataccacagttgtgctcaccatcattgacgaaaatgacaacgttcctgtggttatagggcctgcattgcgtaataatacggcagaaatcaccattcccaaaggggctgaaagtggctttcatgtcacaagaataagggcaattgacagagactctggtgtgaatgctgaactcagctgcgccatagtagcaggtaatgaggagaatatcttcataattgatccacgatcatgtgacatccataccaacgttagcatggattctgttccctacacagaatgggagctgtcagttatcattcaggacaaaggcaatcctcagctacataccaaagtccttctgaagtgcatgatctttgaatatgcagagtcggtgacaagtacagcaatgacttcagtaagccaggcatccttggatgtctccatgataataattatttccttaggagcaatttgtgcagtgttgctggttattatggtgctatttgcaactaggtgtaaccgcgagaagaaagacactagatcctataactgcagggtggccgaatcaacttaccagcaccacccaaaaaggccatcccggcagattcacaaaggggacatcacattggtgcctaccataaatggcactctgcccatcagatctcatcacagatcgtctccatcttcatctcctaccttagaaagagggcagatgggcagccggcagagtcacaacagtcaccagtcactcaacagtttggtgacaatctcatcaaaccacgtgccagagaatttctcattagaactcacccacgccactcctgctgttgagcaggtctctcagcttctttcaatgcttcaccaggggcaatatcagccaagaccaagttttcgaggaaacaaatattccaggagctacagatatgcccttcaagacatggacaaatttagcttgaaagacagtggccgtggtgacagtgaggcaggagacagtgattatgatttggggcgagattctccaatagataggctgttgggtgaaggattcagcgacctgtttctcacagatggaagaattccagcagctatgagactctgcacggaggagtgcagggtcctgggacactctgaccagtgctggatgccaccactgccctcaccgtcttctgattataggagtaacatgttcattccaggggaagaattcccaacgcaaccccagcagcagcatccacatcagagtcttgaggatgacgctcagcctgcagattccggtgaaaagaagaagagtttttccacctttggaaaggactccccaaacgatgaggacactggggataccagcacatcatctctgctctcggaaatgagcagtgtgttccagcgtctcttaccgccttccctggacacctattctgaatgcagtgaggtggatcggtccaactccctggagcgcaggaagggacccttgccagccaaaactgtgggttacccacagggggtagcggcatgggcagccagtacgcattttcaaaatcccaccaccaactgtgggccgccacttggaactcactccagtgtgcagccttcttcaaaatggctgccagccatggaggagatccctgaaaattatgaggaagatgattttgacaatgtgctcaaccacctcaatgatgggaaacacgaactcatggatgccagtgaactggtggcagagattaacaaactgcttcaagatgtccgccagagctaggagattttagcgaagcatttttgtttccatgtatatggaaatagggaacaacaacaacaacaaaaaaccctgaaagaactggcattgccaaatagttgcatttatcataaatgtgtctgtgtatattgaatattaaatactgtattttcgtatgtacacaaaaaaaaaaaaaaaaaaaaaaaaaaaaaaaaaaaaaaaaaaaaaaaag

SEQ ID NO: 41 - DNA, 3540 bp, Mus sp.
atgatgctacttctgccattcctgctagggctcttagggccaggaagctacttgttcatttcaggggattgtcaggaggtggccactgtcatggtgaaattccaagtgacagaggaagtgccgtctggcacggtgatagggaaactgtcccaagaactaagagtggaggagaggcgtgggaaggcaggagatgccttccagattctgcagctgcctcaggcactgccggttcagatgaactctgaggacggcctgctcagcacttccagccggctggatcgggagaagctatgtcggcaggaagatccctgtctggtgtcatttgacgtgcttgccacaggggcgtctgctctaattcatgtggagattcaggtgctagacatcaatgaccaccagccacagtttcccaaagacgagcaggaactggaaatctcagagagtgcctctctgcacacacgaatccccttggacagagctcttgaccaagacacgggtcctaacagcttatattcctactccctgtctcccagtgaacactttgccctggatgttattgtgggccctgatgagaccaaacatgcagagcttgtggtggtgaaggagttggacagggaactccactcatattttgatctggtgctgaccgcctatgacaatgggaatccccctaagtcaggaatcagcgtggtcaaggtcaatgtcctggactccaatgacaatagtccagtgtttgctgagagttcactagcactagaaatcccagaagacactgttcctggtactcttctcataaacctgactgctacagatcccgaccaaggacccaatggggaggtagagttcttctttggcaagcatgtgtccccagaggtgatgaacacctttggcatagatgccaagacaggccagatcattctgcgccaagccctagattacgagaagaaccctgcctatgaggtggatgtccaggcaagggatttgggtcccaattccatcccaggccattgcaaagttcttatcaaagttctggatgtcaatgacaatgccccaagcatcctcatcacgtgggcctcccagacgtcgctggtgtcagaagatcttcccagggatagcttcattgcccttgtcagtgcgaatgacttggactcaggaaacaacggtctcgtccactgttggctgaatcaagagctgggccacttcagactgaaaaggactaacggcaacacgtacatgctgctcaccaatgccacactggacagagagcagtggcccatatatactctcactgtgtttgcccaagaccaaggaccccagcccttatcagctgagaaggagctccaaattcaggttagtgatgtcaatgacaatgcccctgtgtttgagaagagccggtacgaggtctccacttgggaaaataacccaccctctcttcacctcatcacgctcaaagcgcatgatgctgacttgggcagtaatggaaaagtgtcataccgtatcaaggactcccccgtttctcacttagtcattattgactttgaaacaggagaagtcactgctcagaggtcactggactatgaacagatggcaggctttgagttccaggtgatagcagaggacagagggcaaccccagctcgcatccagcatctcggtgtgggttagcctcttggatgccaatgataatgccccagaagtgattcagcctgtgctcagtgaaggcaaagccaccctttcggtgcttgtaaatgcctccacgggccaccttctgttgcccattgagaatcccagtggcatggatccagcaggtactggtataccaccaaaggctacccacagcccctggtctttccttttgttaacaatcgtggctagggatgcagactcgggggccaatggggaactcttctacagcattcaaagtgggaatgatgctcatctctttttcctcagcccttccttggggcagctattcattaatgtcaccaatgccagcagcctcatcgggagtcagtgggacctggggatagtggtagaggaccagggcagcccctccttgcagacccaagtttcattgaaggtcgtgtttgtcaccagtgtggaccacctaagggattctgctcatgagcccggagttctgagcacaccagcactggctttgatctgcctggctgtactgctggccatctttggattgctcttagccctgttcgtgtccatctgcaggacagagagaaaggataatagggcctacaactgtcgagaagctgagtcgtcataccgccaccagcccaagaggccccagaaacacattcagaaggcagatatccacctggtgcctgtgcttagggcccacgagaatgagactgatgaagtcaggccatctcacaaggataccagcaaggagacactgatggaggcaggctgggactcttgcctggaggcccccttccacctcacaccaaccctatacaggaccctgcgtaaccaaggcaaccagggagaactggcagagagccaggaggtactgcaggacaccttcaactttctctttaaccatcccaggcagaggaatgcctcccgggagaacctaaaccttcctgagtccccacctgctgtacgccaaccactcttaaggcctctgaaggtgcctggtagccccatagcgagggcgactggagaccaagacaaggaggaggccccacagagcccaccagcgtcctctgcaaccctaagacgacagcggaatttcaatggcaaagtgtctcctagaggagagtccggtcctcatcagattctgaggagcctggttaggctctctgtggctgcttttgcggaacggaacccggtggaggagcctgctggggactctcctcctgtccagcaaatctcccagctgctgtccttgctgcaccagggccaattccagcccaaaccaaaccaccgaggaaataaatacttggccaagcccggcggcagcagcaggggtaccatcccagacacagagggccttgtaggcctcaagcctagtggccaagcagaacctgacctggaagaagggcccccgagcccggaggaggacctttctgtaaagcgacttctagaagaagagctgtcgagcctgttggaccctaatacaggtctagccctggacaagctgagtccgcctgacccagcctggatggcgagattgtcattgcccctcaccaccaattatcgagacaacttgtcttcccccgatgctacaacatcagaggaaccgagaaccttccagacattcggcaagacagttggaccgggacccgagctgagcccaacaggcacgcgcctggccagcactttcgtctcggagatgagctctctgctggaaatgttgttggggcagcacacggtaccagtggaagctgcgtccgcggctttgcggaggctctcggtgtgcgggaggaccctcagtctagacctagccaccagtggggcttcagcttcagaagcacagggtagaaagaaggcagctgagagcagacttggctgtggcaggaatcta

SEQ ID NO: 42 - protein, 1135 aa, Mus sp.
MMLLLPFLLGLLGPGSYLFISGDCQEVATVMVKFQVTEEVPSGTVIGKDAFQILQLPQALPVQMNSEDGLLSTSSRLDREKLCRQEDPCLVSFDVLATGASALIHVEIQVLDINDHQPQFPKDEQELEISESASLHTRIPLDRALDQDTGPNSLYSYSLSPSEHFALDVIVGPDETKHAELVVVKELDRELHSYFDLVLTAYDNGNPPKSGISVVKVNVLDSNDNSPVFAESSLALEIPEDTVPGTLLINLTATDPDQGPNGEVEFFFGKHVSPEVMNTFGIDAKTGQIILRQALDYEKNPAYEVDVQARDLGPNSIPGHCKVLIKVLDVNDNAPSILITWASQTSLVSEDLPRDSFIALVSANDLDSGNNGLVHCWLNQELGHFRLKRTNGNTYMLLTNATLDREQWPIYTLTVFAQDQGPQPLSAEKELQIQVSDVNDNAPVFEKSRYEVSTWENNPPSLHLITLKAHDADLGSNGKVSYRIKDSPVSHLVIIDFETGEVTAQRSLDYEQMAGFEFQVIAEDRGQPQLASSISVWVSLLDANDNAPEVIQPVLSEGKATLSVLVNASTGHLLLPIENPSGMDPAGTGIPPKATHSPWSFLLLTIVARDADSGANGELFYSIQSGNDAHLFFLSPSLGQLFINVTNASSLIGSQWDLGIVVEDQGSPSLQTQVSLKVVFVTSVDHLRDSAHEPGVLSTPALALICLAVLLAIFGLLLALFVSICRTERKDNRAYNCREAESSYRHQPKRPQKHIQKADIHLVPVLRAHENETDEVRPSHKDTSKETLMEAGWDSCLEAPFHLTPTLYRTLRNQGNQGELAESQEVLQDTFNFLFNHPRQRNASRENLNLPESPPAVRQPLLRPLKVPGSPIARATGDQDKEEAPQSPPASSATLRRQRNFNGKVSPRGESGPHQILRSLVRLSVAAFAERNPVEEPAGDSPPVQQISQLLSLLHQGQFQPKPNHRGNKYLAKPGGSSRGTIPDTEGLVGLKPSGQAEPDLEEGPPSPLSSLLDPNTGLALDKLSPPDPAWMARLSLPLTSEEPRTFQTFGKTVGPGPELSPTGTRLASTFVSEMSSLLEMLLGQHTVPVEAASAALRRLSVCGRTLSLDLATSGASASEAQGRKKAAESRLGCG

SEQ ID NO: 43 - skipped
  Unknown

SEQ ID NO: 44 - skipped
  Unknown

SEQ ID NO: 45 - skipped
  Unknown

SEQ ID NO: 46 - skipped
  Unknown

SEQ ID NO: 47 - skipped
  Unknown

SEQ ID NO: 48 - skipped
  Unknown

SEQ ID NO: 49 - skipped
  Unknown

SEQ ID NO: 50 - skipped
  Unknown

SEQ ID NO: 51 - DNA, 2330 bp, Homo sapiens
gaagtgggatgtgcaaaagcgccggctggaaatcccggctgtgtctccgtcaactctttacgcaacagaggtctccccctgcccttggtttctaccgggccgcctgctcccactcggcgaaaaaaattacacaacagcagccgcggcgatgacgtggagggctgccgcctccacgtgcgcggcgctcctgattctgctgtgggcgctgacgaccgaaggtgatctgaaagtagagatgatggcaggggggactcagatcacacccctgaatgacaatgtcaccatattctgcaatatcttttattcccaacccctcaacatcacgtctatgggtatcacctggttttggaagagtctgacgtttgacaaagaagtcaaagtctttgaattttttggagatcaccaagaggcattccgacctggagccattgtgtctccatggaggctgaagagtggggacgcctcactgcggctgcctggaatccagctggaggaagcaggagagtaccgatgtgaggtggtggtcacccctctgaaggcacagggaacagtccagcttgaagttgtggcttccccagccagcagattgttgctggatcaagtgggcatgaaagagaatgaagacaaatatatgtgtgagtcaagtgggttctacccagaggctattaatataacatgggagaagcagacccagaagtttccccatcccatagagatttctgaggatgtcatcactggtcccaccatcaagaatatggatggcacatttaatgtcactagctgcttgaagctgaactcctctcaggaagaccctgggactgtctaccagtgtgtggtacggcatgcgtccttgcatacccccttgaggagcaactttaccctgactgctgctcggcacagtctttctgaaactgagaagacagataatttttccattcattggtggcctatttcattcattggtgttggactggttttattaattgttttgattccttggaaaaaggtaaggggctccaaagcaaagttcagccctgtgtcttgggctagtaaaaagcttttagagcagctgctgccaaccttacaagcctcaagggacaggcctgctggaaaggactttgtcagtccctcttcaccatcaggtgttgggaatgttggctgtgttccaatccagtttcctatcacagaggacctagctgtcacataccatctgacctctgtatggtggtttgtgactctggggtgatgtgttgtaaagcctccctctctttctccatactaaacaagtattatatctctgtgaatgaaccagactttagtgttcagaccaggccctgaactatgtgtggactgcttgtttttctcacacatttagaaactatggcttagagaggggaattcctcatattttatctgatcaataactgaccaccagatctcactagtttgactaagaatttctaaccctcactaggtatttctaaactaaaacatgtttctaaacatttttatccctgactatggcccaaatagtaaataaaacagctcaagctttagaggcccaagagacctatgtaaatgtgttggttaaaatagttttagataataaaagggccctcaattatttatgggcctgtcaaggcaaaatctgcacaacagccagtacatctcattataaataatttaggagaagtggaataatcagtcaattaagaaaaatggccctttatctaaagttggccatttagattcacgggacttattcctgttggatctaggccatgagaaaactggataaaaagtggttttcaaatgtttcttgtggtatttgtgactgttgtcatatttcttgcctttctctggttctgatattcaggtgctattgagagaggaggaaggaagaaactagtcaggcaggcagttagggtgggccctcagtcaaattccttcaaacaaaagaacagcctgaaaaatcaaactgcagataagggaacttgtacaggggggcttgcctaaaacatgcccacagccacatacattaaaacaaggctacacaggagacttgcctagacatgctcacaatagaaaattccatcccctgacacatgcacagtaaggggaacaaagccacatggagtaactcaagctaagggcttgcatgcacactacgaggatggggtggagctaccagaaatgtgtgccttatgcctttgtattcagctgtgaaatggcaaccctcttttgggccccctctctgcagtggagtgctttcttcttttgcttattaaactttcacttcaacttcaaaaaaaaaaaaaaaaaaaaaaaaa

SEQ ID NO: 52 - DNA, 1095 bp, Homo sapiens
atgacgtggagggctgccgcctccacgtgcgcggcgctcctgattctgctgtgggcgctgacgaccgaaggtgatctgaaagtagagatgatggcaggggggactcagatcacacccctgaatgacaatgtcaccatattctgcaatatcttttattcccaacccctcaacatcacgtctatgggtatcacctggttttggaagagtctgacgtttgacaaagaagtcaaagtctttgaattttttggagatcaccaagaggcattccgacctggagccattgtgtctccatggaggctgaagagtggggacgcctcactgcggctgcctggaatccagctggaggaagcaggagagtaccgatgtgaggtggtggtcacccctctgaaggcacagggaacagtccagcttgaagttgtggcttccccagccagcagattgttgctggatcaagtgggcatgaaagagaatgaagacaaatatatgtgtgagtcaagtgggttctacccagaggctattaatataacatgggagaagcagacccagaagtttccccatcccatagagatttctgaggatgtcatcactggtcccaccatcaagaatatggatggcacatttaatgtcactagctgcttgaagctgaactcctctcaggaagaccctgggactgtctaccagtgtgtggtacggcatgcgtccttgcatacccccttgaggagcaactttaccctgactgctgctcggcacagtctttctgaaactgagaagacagataatttttccattcattggtggcctatttcattcattggtgttggactggttttattaattgttttgattccttggaaaaaggtaaggggctccaaagcaaagttcagccctgtgtcttgggctagtaaaaagcttttagagcagctgctgccaaccttacaagcctcaagggacaggcctgctggaaaggactttgtcagtccctcttcaccatcaggtgttgggaatgttggctgtgttccaatccagtttcctatcacagaggacctagctgtcacataccatctgacctctgtatggtggtttgtgactctgggg

SEQ ID NO: 53 - protein, 365 aa, Homo sapiens
MTWRAAASTCAALLILLWALTTEGDLKVEMMAGGTQITPLNDNVTIFCNIFYSQPLNITSMGITWFWKSLTFDKEVKVFEFFGDHQEAFRPGAIVSPWRLKSGDASLRLPGIQLEEAGEYRCEVVVTPLKAQGTVQLEVVASPASRLLLDQVGMKENEDKYMCESSGFYPEAINITWEKQTQKFPHPIEISEDVITGPTIKNMDGTFNVTSCLKLNSSQEDPGTVYQCVVRHASLHTPLRSNFTLTAARHSLSETEKTDNFSIHWWPISFIGVGLVLLIVLIPWKKVRGSKAKFSPVSWASKKLLEQLLPTLQASRDRPAGKDFVSPSSPSGVGNVGCVPIQFPITEDLAVTYHLTSVWWFVTLG

SEQ ID NO: 54 - protein, 341 aa, Homo sapiens
DLKVEMMAGGTQITPLNDNVTIFCNIFYSQPLNITSMGITWFWKSLTFDKEVKVFEFFGDHQEAFRPGAIVSPWRLKSGDASLRLPGIQLEEAGEYRCEVVVTPLKAQGTVQLEVVASPASRLLLDQVGMKENEDKYMCESSGFYPEAINITWEKQTQKFPHPIEISEDVITGPTIKNMDGTFNVTSCLKLNSSQEDPGTVYQCVVRHASLHTPLRSNFTLTAARHSLSETEKTDNFSIHWWPISFIGVGLVLLIVLIPWKKVRGSKAKFSPVSWASKKLLEQLLPTLQASRDRPAGKDFVSPSSPSGVGNVGCVPIQFPITEDLAVTYHLTSVWWFVTLG

SEQ ID NO: 55 - protein, 24 aa, Homo sapiens
MTWRAAASTCAALLILLWALTTEG

SEQ ID NO: 56 - protein, 239 aa, Homo sapiens
LKVEMMAGGTQITPLNDNVTIFCNIFYSQPLNITSMGITWFWKSLTFDKEVKVFEFFGDHQEAFRPGAIVSPWRLKSGDASLRLPGIQLEEAGEYRCEVVVTPLKAQGTVQLEVVASPASRLLLDQVGMKENEDKYMCESSGFYPEAINITWEKQTQKFPHPIEISEDVITGPTIKNMDGTFNVTSCLKLNSSQEDPGTVYQCVVRHASLHTPLRSNFTLTAARHSLSETEKTDNFSIH

SEQ ID NO: 57 - protein, 84 aa, Homo sapiens
NDNVTIFCNIFYSQPLNITSMGITWFWKSLTFDKEVKVFEFFGDHQEAFRPGAIVSPWRLKSGDASLRLPGIQLEEAGEYRCEV

SEQ ID NO: 58 - protein, 68 aa, Homo sapiens
CESSGFYPEAINITWEKQTQKFPHPIEISEDVITGPTIKNMDGTFNVTSCLKLNSSQEDPGTVYQCVV

SEQ ID NO: 59 - protein, 18 aa, Homo sapiens
WWPISFIGVGLVLLIVLI

SEQ ID NO: 60 - protein, 83 aa, Homo sapiens
PWKKVRGSKAKFSPVSWASKKLLEQLLPTLQASRDRPAGKDFVSPSSPSGVGNVGCVPIQFPITEDLAVTYHLTSVWWFVTLG

SEQ ID NO: 61 - DNA, 1402 bp, Homo sapiens
gaagttgaagtgaaagtttaataagcaaaagaagaaagcactccactgcagagagggggcccaaaagagggttgccatttcacagctgaatacaaaggcataaggcacacatttctggtagctccaccccatcctcgtagtgtgcatgcaagcccttagcttgagttactccatgtggctttgttccccttactgtgcatgtgtcaggggatggaattttctattgtgagcatgtctaggcaagtctcctgtgtagccttgttttaatgtatgtggctgtgggcatgttttaggcaagcccccctgtacaagttcccttatctgcagtttgatttttcaggctgttcttttgtttgaaggaatttgactgagggcccaccctaactgcctgcctgactagtttcttccttcctcctctctcaatagcacctgaatatcagaaccagagaaaggcaagaaatatgacaacagtcacaaataccacaagaaacatttgaaaaccactttttatccagttttctcatggcctagatccaacaggaataagtcccgtgaatctaaatggccaactttagataaagggccatttttcttaattgactgattattccacttctcctaaattatttataatgagatgtactggctgttgtgcagattttgccttgacaggcccataaataattgagggcccttttattatctaaaactattttaaccaacacatttacataggtctcttgggcctctaaagcttgagctgttttatttactatttgggccatagtcagggataaaaatgtttagaaacatgttttagtttagaaatacctagtgagggttagaaattcttagtcaaactagtgagatctggtggtcagttattgatcagataaaatatgaggaattcccctctctaagccatagtttctaaatgtgtgagaaaaacaagcagtccacacatagttcagggcctggtctgaacactaaagtctggttcattcacagagatataatacttgtttagtatggagaaagagagggaggctttacaacacatcaccccagagtcacaaaccaccatacagaggtcagatggtatgtgacagctaggtcctctgtgataggaaactggattggaacacagccaacattcccaacacctgatggtgaagagggactgacaaagtcctttccagcaggcctgtcccttgaggcttgtaaggttggcagcagctgctctaaaagctttttactagcccaagacacagggctgaactttgctttggagccccttacctttttccaaggaatcaaaacaattaataaaaccagtccaacaccaatgaatgaaataggccaccaatgaatggaaaaattatctgtcttctcagtttctgca

SEQ ID NO: 62 - skipped
  Unknown

SEQ ID NO: 63 - skipped
  Unknown

SEQ ID NO: 64 - skipped
  Unknown

SEQ ID NO: 65 - skipped
  Unknown

SEQ ID NO: 66 - skipped
  Unknown

SEQ ID NO: 67 - skipped
  Unknown

SEQ ID NO: 68 - skipped
  Unknown

SEQ ID NO: 69 - skipped
  Unknown

SEQ ID NO: 70 - skipped
  Unknown

SEQ ID NO: 71 - DNA, 3594 bp, Homo sapiens
ggcccgggcagctgcggctcgggatccgtcgaggggaggccgagcttgccaagctggcgcccagcggggtcatggtgcccggcgcccgcggcggcggcgcactggcgcgggctgccgggcggggcctcctggctttgctgctcgcggtctccgccccgctccggctgcaggcggaggagctgggtgatggctgtggacacctagtgacttatcaggatagtggcacaatgacatctaagaattatcccgggacctaccccaatcacactgtttgcgaaaagacaattacagtaccaaaggggaaaagactgattctgaggttgggagatttggatatcgaatcccagacctgtgcttctgactatcttctcttcaccagctcttcagatcaatatggtccatactgtggaagtatgactgttcccaaagaactcttgttgaacacaagtgaagtaaccgtccgctttgagagtggatcccacatttctggccggggttttttgctgacctatgcgagcagcgaccatccagatttaataacatgtttggaacgagctagccattatttgaagacagaatacagcaaattctgcccagctggttgtagagacgtagcaggagacatttctgggaatatggtagatggatatagagatacctctttattgtgcaaagctgccatccatgcaggaataattgctgatgaactaggtggccagatcagtgtgcttcagcgcaaagggatcagtcgatatgaagggattctggccaatggtgttctttcgagggatggttccctgtcagacaagcgatttctgtttacctccaatggttgcagcagatccttgagttttgaacctgacgggcaaatcagagcttcttcctcatggcagtcggtcaatgagagtggagaccaagttcactggtctcctggccaagcccgacttcaggaccaaggcccatcatgggcttcgggcgacagtagcaacaaccacaaaccacgagagtggctggagatcgatttgggggagaaaaagaaaataacaggaattaggaccacaggatctacacagtcgaacttcaacttttatgttaagagttttgtgatgaacttcaaaaacaataattctaagtggaagacctataaaggaattgtgaataatgaagaaaaggtgtttcagggtaactctaactttcgggacccagtgcaaaacaatttcatccctcccatcgtggccagatatgtgcgggttgtcccccagacatggcaccagaggatagccttgaaggtggagctcattggttgccagattacacaaggtaatgattcattggtgtggcgcaagacaagtcaaagcaccagtgtttcaactaagaaagaagatgagacaatcacaaggcccatcccctcggaagaaacatccacaggaataaacattacaacggtggctattccattggtgctccttgttgtcctggtgtttgctggaatggggatctttgcagcctttagaaagaagaagaagaaaggaagtccgtatggatcagcagaggctcagaaaacagactgttggaagcagattaaatatccctttgccagacatcagtcagctgagtttaccatcagctatgataatgagaaggagatgacacaaaagttagatctcatcacaagtgatatggcagattaccagcagcccctcatgattggcaccgggacagtcacgaggaagggctccaccttccggcccatggacacggatgccgaggaggcaggggtgagcaccgatgccggcggccactatgactgcccgcagcgggccggccgccacgagtacgcgctgcccctggcgcccccggagcccgagtacgccacgcccatcgtggagcggcacgtgctgcgcgcccacacgttctctgcgcagagcggctaccgcgtcccagggccccagcccggccacaaacactccctctcctcgggcggcttctcccccgtagcgggtgtgggcgcccaggacggagactatcaaaggccacacagcgcacagcctgcggacaggggctacgaccggcccaaagctgtcagcgccctcgccaccgaaagcggacaccctgactctcagaagcccccaacgcatcccgggacgagtgacagctattctgcccccagagactgcctcacacccctcaaccagacggccatgactgcccttttgtgaacacaatgtgaaagaagcctgctgtggtactgagcgtcgggctgtcacaaggcactggaagaagggagcctgctggtccagagtgtgcgtgtgtatcggtgtgtgtgtacacttgcatgtgtgtgtgtgatccagtaggatcctagagacaacctgtcatactgtttacaaaattgtgcagctggtttcgtgctgacccttagggtgcgtctgttgggttttgttgggctagaaaaatgaaaatttttagatggcgttttcattcctctgactgatattgagctgctttggtgttaaaggtgtaatgtgtacagagttgtatttaacaataataaaagtaacttaagtttgctctatcagattttagttctgcacagaggttaagtgggaaaatgcagctgttgcaaaatgtatataaatagtatgttcatttttttcagtatattatctgatactgtgttagcagcaggtctgcttaaacctagtcttgttgttattgagtcatttcctctcctttgataactagaactgaaagcatttttaacattcttctcctggaagaaatgaattacttgaagcatgaaaagcacaccagggtggttgtttatttagcaattatgactgtagatttaaaaacaagcaaagaaacaacacctcagcagctgcccgtttccttagtctccacttcagagggggatgcgaagaggtcggcccagctccggtgaccatgaaggtggcacaggaattacagtgtgaatggctgtgtcagatgttttcgtacctcagattaaaaatattgctgaggtcagacgccacaattttcatgactttcttcagaagtagcacattttcgtgacttccgctgtcctctgaaaaacaaagttatttggaacatgttcatgcaaaagtgattctgaccaagtctaaatcgagcttttctactgacatgaaactgttggaaactgatctcattttataagaaatgattttcccctcaaggaggcgtctgtaattccagaacagtccagacatcagctgtacctcatgctcagtagtttttatttgagtttcttttgtgagttaactatgggagatttaacctcttttgccaaagagggaagtgtgtgtgtttttttaatagaaaatatggaccaaaaatttttttccctgaagaatgtattataaccctatttgtgtggttattacatcctgtgaaatgtatatatgttaaaataatgggggtgctggaaggtcatggcagactagctgctggttagtgtggaggggaagtggtttactttgtagagtttacatggttttatgcgcacactaattgtaataaactatgccaaaccaaataaaaaaaaaaaaaaaa

SEQ ID NO: 72 - DNA, 2145 bp, Homo sapiens
atggtgcccggcgcccgcggcggcggcgcactggcgcgggctgccgggcggggcctcctggctttgctgctcgcggtctccgccccgctccggctgcaggcggaggagctgggtgatggctgtggacacctagtgacttatcaggatagtggcacaatgacatctaagaattatcccgggacctaccccaatcacactgtttgcgaaaagacaattacagtaccaaaggggaaaagactgattctgaggttgggagatttggatatcgaatcccagacctgtgcttctgactatcttctcttcaccagctcttcagatcaatatggtccatactgtggaagtatgactgttcccaaagaactcttgttgaacacaagtgaagtaaccgtccgctttgagagtggatcccacatttctggccggggttttttgctgacctatgcgagcagcgaccatccagatttaataacatgtttggaacgagctagccattatttgaagacagaatacagcaaattctgcccagctggttgtagagacgtagcaggagacatttctgggaatatggtagatggatatagagatacctctttattgtgcaaagctgccatccatgcaggaataattgctgatgaactaggtggccagatcagtgtgcttcagcgcaaagggatcagtcgatatgaagggattctggccaatggtgttctttcgagggatggttccctgtcagacaagcgatttctgtttacctccaatggttgcagcagatccttgagttttgaacctgacgggcaaatcagagcttcttcctcatggcagtcggtcaatgagagtggagaccaagttcactggtctcctggccaagcccgacttcaggaccaaggcccatcatgggcttcgggcgacagtagcaacaaccacaaaccacgagagtggctggagatcgatttgggggagaaaaagaaaataacaggaattaggaccacaggatctacacagtcgaacttcaacttttatgttaagagttttgtgatgaacttcaaaaacaataattctaagtggaagacctataaaggaattgtgaataatgaagaaaaggtgtttcagggtaactctaactttcgggacccagtgcaaaacaatttcatccctcccatcgtggccagatatgtgcgggttgtcccccagacatggcaccagaggatagccttgaaggtggagctcattggttgccagattacacaaggtaatgattcattggtgtggcgcaagacaagtcaaagcaccagtgtttcaactaagaaagaagatgagacaatcacaaggcccatcccctcggaagaaacatccacaggaataaacattacaacggtggctattccattggtgctccttgttgtcctggtgtttgctggaatggggatctttgcagcctttagaaagaagaagaagaaaggaagtccgtatggatcagcagaggctcagaaaacagactgttggaagcagattaaatatccctttgccagacatcagtcagctgagtttaccatcagctatgataatgagaaggagatgacacaaaagttagatctcatcacaagtgatatggcagattaccagcagcccctcatgattggcaccgggacagtcacgaggaagggctccaccttccggcccatggacacggatgccgaggaggcaggggtgagcaccgatgccggcggccactatgactgcccgcagcgggccggccgccacgagtacgcgctgcccctggcgcccccggagcccgagtacgccacgcccatcgtggagcggcacgtgctgcgcgcccacacgttctctgcgcagagcggctaccgcgtcccagggccccagcccggccacaaacactccctctcctcgggcggcttctcccccgtagcgggtgtgggcgcccaggacggagactatcaaaggccacacagcgcacagcctgcggacaggggctacgaccggcccaaagctgtcagcgccctcgccaccgaaagcggacaccctgactctcagaagcccccaacgcatcccgggacgagtgacagctattctgcccccagagactgcctcacacccctcaaccagacggccatgactgcccttttg

SEQ ID NO: 73 - protein, 715 aa, Homo sapiens
MVPGARGGGALARAAGRGLLALLLAVSAPLRLQAEELGDGCGHLVTYQDSGTMTSKNYPGTYPNHTVCEKTITVPKGKRLILRLGDLDIESQTCASDYLLFTSSSDQYGPYCGSMTVPKELLLNTSEVTVRFESGSHISGRGFLLTYASSDHPDLITCLERASHYLKTEYSKFCPAGCRDVAGDISGNMVDGYRDTSLLCKAAIHAGIIADELGGQISVLQRKGISRYEGILANGVLSRDGSLSDKRFLFTSNGCSRSLSFEPDGQIRASSSWQSVNESGDQVHWSPGQARLQDQGPSWASGDSSNNHKPREWLEIDLGEKKKITGIRTTGSTQSNFNFYVKSFVMNFKNNNSKWKTYKGIVNNEEKVFQGNSNFRDPVQNNFIPPIVARYVRVVPQTWHQRIALKVELIGCQITQGNDSLVWRKTSQSTSVSTKKEDETITRPIPSEETSTGINITTVAIPLVLLVVLVFAGMGIFAAFRKKKKKGSPYGSAEAQKTDCWKQIKYPFARHQSAEFTISYDNEKEMTQKLDLITSDMADYQQPLMIGTGTVTRKGSTFRPMDTDAEEAGVSTDAGGHYDCPQRAGRHEYALPLAPPEPEYATPIVERHVLRAHTFSAQSGYRVPGPQPGHKHSLSSGGFSPVAGVGAQDGDYQRPHSAQPADRGYDRPKAVSALATESGHPDSQKPPTHPGTSDSYSAPRDCLTPLNQTAMTALL

SEQ ID NO: 74 - protein, 34 aa, Homo sapiens
MVPGARGGGALARAAGRGLLALLLAVSAPLRLQA

SEQ ID NO: 75 - protein, 681 aa, Homo sapiens
EELGDGCGHLVTYQDSGTMTSKNYPGTYPNHTVCEKTITVPKGKRLILRLGDLDIESQTCASDYLLFTSSSDQYGPYCGSMTVPKELLLNTSEVTVRFESGSHISGRGFLLTYASSDHPDLITCLERASHYLKTEYSKFCPAGCRDVAGDISGNMVDGYRDTSLLCKAAIHAGIIADELGGQISVLQRKGISRYEGILANGVLSRDGSLSDKRFLFTSNGCSRSLSFEPDGQIRASSSWQSVNESGDQVHWSPGQARLQDQGPSWASGDSSNNHKPREWLEIDLGEKKKITGIRTTGSTQSNFNFYVKSFVMNFKNNNSKWKTYKGIVNNEEKVFQGNSNFRDPVQNNFIPPIVARYVRVVPQTWHQRIALKVELIGCQITQGNDSLVWRKTSQSTSVSTKKEDETITRPIPSEETSTGINITTVAIPLVLLVVLVFAGMGIFAAFRKKKKKGSPYGSAEAQKTDCWKQIKYPFARHQSAEFTISYDNEKEMTQKLDLITSDMADYQQPLMIGTGTVTRKGSTFRPMDTDAEEAGVSTDAGGHYDCPQRAGRHEYALPLAPPEPEYATPIVERHVLRAHTFSAQSGYRVPGPQPGHKHSLSSGGFSPVAGVGAQDGDYQRPHSAQPADRGYDRPKAVSALATESGHPDSQKPPTHPGTSDSYSAPRDCLTPLNQTAMTALL

SEQ ID NO: 76 - protein, 421 aa, Homo sapiens
EELGDGCGHLVTYQDSGTMTSKNYPGTYPNHTVCEKTITVPKGKRLILRLGDLDIESQTCASDYLLFTSSSDQYGPYCGSMTVPKELLLNTSEVTVRFESGSHISGRGFLLTYASSDHPDLITCLERASHYLKTEYSKFCPAGCRDVAGDISGNMVDGYRDTSLLCKAAIHAGIIADELGGQISVLQRKGISRYEGILANGVLSRDGSLSDKRFLFTSNGCSRSLSFEPDGQIRASSSWQSVNESGDQVHWSPGQARLQDQGPSWASGDSSNNHKPREWLEIDLGEKKKITGIRTTGSTQSNFNFYVKSFVMNFKNNNSKWKTYKGIVNNEEKVFQGNSNFRDPVQNNFIPPIVARYVRVVPQTWHQRIALKVELIGCQITQGNDSLVWRKTSQSTSVSTKKEDETITRPIPSEETSTGIN

SEQ ID NO: 77 - protein, 25 aa, Homo sapiens
ITTVAIPLVLLVVLVFAGMGIFAAF

SEQ ID NO: 78 - protein, 235 aa, Homo sapiens
RKKKKKGSPYGSAEAQKTDCWKQIKYPFARHQSAEFTISYDNEKEMTQKLDLITSDMADYQQPLMIGTGTVTRKGSTFRPMDTDAEEAGVSTDAGGHYDCPQRAGRHEYALPLAPPEPEYATPIVERHVLRAHTFSAQSGYRVPGPQPGHKHSLSSGGFSPVAGVGAQDGDYQRPHSAQPADRGYDRPKAVSALATESGHPDSQKPPTHPGTSDSYSAPRDCLTPLNQTAMTALL

SEQ ID NO: 79 - skipped
  Unknown

SEQ ID NO: 80 - skipped
  Unknown

SEQ ID NO: 81 - DNA, 4074 bp, Homo sapiens
  misc_feature (1)...(4074): n = A,T,C or G
gtggtcgcggccgaggtgagactgtgaagaaggaagaacgttgcttgggcaaaaggagcatattctcaggagacggggcccctgcctgccacaccaagcattaggccaccaggaagacccccatctgcaagcaagcctagccttccagggagaaagaggcccctgcagctccttcatcatgaactggcacatgatcatctctgggcttattgtggtagtgcttaaagttgttggaatgaccttatttctactttatttcccacagatttttaacaaaagtaacgatggtttcaccaccaccaggagctatggaacagtctcacagatttttgggagcagttccccaagtcccaacggcttcattaccacaaggagctatggaacagtctgccccaaagactgggaattttatcaagcaagatgttttttcttatccacttctgaatcatcttggaatgaaagcagggacttttgcaaaggaaaaggatccacattggcaattgtcaacacgccagagaaactgaagtttcttcaggacataactgatgctgagaagtattttattggcttaatttaccatcgtgaagagaaaaggtggcgttggatcaacaactctgtgttcaatggcaatgttaccaatcagaatcagaatttcaactgtgcgaccattggcctaacaaagacatttgatgctgcatcatgtgacatcagctaccgcaggatctgtgagaagaatgccaaatgatcacagttccctgtgacaagaactatacttgcaactctttttgaatccatacaggtcgtctggccaatgattcttttacttacctatctgtctaccagtagcggtccttgcccatttgggaaactgagcttctttcttctgcactgggggactggatgctagccatctccaggagacaggatcagttttacggaaacaactcagttagtatagagatgaggtccgcttctgtagtactgagcatttctgactgatcaaaaaggcctagtctgttgacagggtttgttttattttagcctcagagtataccatactactagggagtaactgtagagtgagaaattataaacattatttagggattaccatggtggaagagggataaacataggtcctgtgacttcgtctctgttctcaagggaaccccattcacatgcccctcctaactccacaagcgagggtagcagaggctctcctcagtctgaactaaggcttggccttggggagggctcctagtgctgagcttggagcagcacggacagcagcattgtttatgggaatggagagaggtctgggcaggataggaaccttcttggagacccctttgaagaaaaccaggcagccaagggagccaaacacactagatttctgttcttcagcaaagccctgaagagacacttaagctaaaaattcccttgtcatatttctgaaactccattataacatatgtaactcctttgtaaccaaaatttaggtaagcaggcttcctttgctctgaaggttttgagtacctggctgtatttgttgagtatttttaaaattttggatagtctcttaggcaacaataatcacaatatattcatcccttcagttctggagaaagcctgataccaggcacagcctactgaccccaaggagcctggcactgattggcatcacattgatctagaactggtccagccgccgaagagtaggaaaagagaagggctgctcagggaaacattggctgggggcacggaataagcacatagtaaaaagggaacatcagggtcaaatggaaatcacctgagacaggaaacagggagttcatttggccacactggaagaaaggcaagaaagaggaagacaagtcttggagtaccctggctgttctccacactcacaagacatcagctatactctgcttggtgcataagaaagagaaaagagatgccttttgtgttttgagtaagaataattaaaccataaggaagaccatgtataaaactgatggaaataatagtcaccaaagtacagcacataccattttgtgtctaataacaatgtagcacagtaatgactgtacatgtcattgtatgtataccaaacaagattgttgtaaatcatattttttattacaacactaagttctgcttctgcattcctaggtttcatcatttttggctccttagcatggccacttacaattttttaacatgagataacacatcaggtgtcagaacttgcttgaagggaattaccagaagtaatttgtgtttgagatggggtggaaattggaattatattagtagccggtggagatacaagttctctgactgtgttgggaaaggataagtgctaccgttgagaagggaagaaaggctgagtctaggtggagaaaaatatcaacagaactctagccaaaggcaagccccagaactcagacaacagaaaggaaatcctaatccttctgttttgagaagagagaactgtagttgcttcacttcctatttcatgacagaataactgcaaacttttaagatcaggaaatgtagacatctagtgatttctttagtagacagtttaatttcccccaagattaggagacacttctgtgcaggttctaaaaggagcccaatggcctggggtgggagtggggagtagatagggaatatgtgggatttggtttaagttcatcattgggagagttcctggatccttgcaagcttagataaatgtgatctttattagatagcagtggcatgcttttaaaaaaaaaaggcaatgaaaatttagcaagccactgaatttgagttttcactttgtttctaatatgctgtgtgaatcagtacagttttcttaccctttcttggtcttaatttccttactgataaaatggggtagtaatacctatctcaaaaaattattgcacatattaaataacattcctctatgtatctcaatggcattagacattaggagaagcattttgtggaggatttgaagttgagatcttcatccaagaagtagcttttcaatttgctagaagcttaatgtaggcaagccacttcatttttcagaacttgtttactcatttataatatgggaataaaaatttgtgcaagtcagagaagggtgccttaaaaatgttgtggccaagccacatgagatcaaagacacacttttcatgacctcaaatgtgggcccagcctaggtcagccaacccccatccaacccttagactcacgaacaaatccacctgagatcagcagagccaccctagatcagctgaaactctaagcacaaaaataaaaacttatcactgtaaaaaaaaaaaaaaaaaaaaaagtctctcgtatagcaaaatctaactgatgcaatctccatctggccttcatccttctccctttattgtcctttcgtgtattgttcatccagcaaccaggatgatcttgttaaaacattaaacagattctgtcaykctttmaaaaaaaaaaaagccatgaaattntagcaagccactgaatttgagttttcactttggtttctaatatgctgtgtgaatcagancagktttcttaccctttcttggtcttaatttccttactgataaaatggggtwgtaatacctatctcaaaaaattattgcacatattarataacattcctctatgtatctcaatggcattagacattaggagaagcattttgtggaggatttgaagttgagatcttcatccaagaagtagcttttcaatttgstagaagcttaatgtaggcaagccacttcatttttcagaacttgtttactcatttataatatgggaataaaaatttgtgcaagtcagagaagggtgccttaaaaatgttgtggccaagccacatgagatcaaagacacacttttcatgacctcaaatgtgggcccagcctaggtcagccaacccccatccaacccttagactcacgaacaaatccacctgagatcagcagagccaccctagatcagctgaaactctaagcacaaaaataaaaacttatcactgtaaaaaaaaaaaaaaaaaaaaaagaa

SEQ ID NO: 82 - DNA, 564 bp, Homo sapiens
atgaactggcacatgatcatctctgggcttattgtggtagtgcttaaagttgttggaatgaccttatttctactttatttcccacagatttttaacaaaagtaacgatggtttcaccaccaccaggagctatggaacagtctcacagatttttgggagcagttccccaagtcccaacggcttcattaccacaaggagctatggaacagtctgccccaaagactgggaattttatcaagcaagatgttttttcttatccacttctgaatcatcttggaatgaaagcagggacttttgcaaaggaaaaggatccacattggcaattgtcaacacgccagagaaactgaagtttcttcaggacataactgatgctgagaagtattttattggcttaatttaccatcgtgaagagaaaaggtggcgttggatcaacaactctgtgttcaatggcaatgttaccaatcagaatcagaatttcaactgtgcgaccattggcctaacaaagacatttgatgctgcatcatgtgacatcagctaccgcaggatctgtgagaagaatgccaaa

SEQ ID NO: 83 - protein, 188 aa, Homo sapiens
MNWHMIISGLIVVVLKVVGMTLFLLYFPQIFNKSNDGFTTTRSYGTVSQIFGSSSPSPNGFITTRSYGTVCPKDWEFYQARCFFLSTSESSWNESRDFCKGKGSTLAIVNTPEKLKFLQDITDAEKYFIGLIYHREEKRWRWINNSVFNGNVTNQNQNFNCATIGLTKTFDAASCDISYRRICEKNAK

SEQ ID NO: 84 - protein, 19 aa, Homo sapiens
SGLIVVVLKVVGMTLFLLY

SEQ ID NO: 85 - protein, 162 aa, Homo sapiens
FPQIFNKSNDGFTTTRSYGTVSQIFGSSSPSPNGFITTRSYGTVCPKDWEFYQARCFFLSTSESSWNESRDFCKGKGSTLAIVNTPEKLKFLQDITDAEKYFIGLIYHREEKRWRWINNSVFNGNVTNQNQNFNCATIGLTKTFDAASCDISYRRICEKNAK

SEQ ID NO: 86 - protein, 187 aa, Homo sapiens
MNWHMIISGLIVVVLKVVGMTLFLLYFPQIFNKSNDGFTTTRSYGTVSQIFGSSSPSPNGFITTRSYGTVCPKDWEFYQARCFFLSTSESSWNESRDFCKGKGSTLAIVNTPEKLFLQDITDAEKYFIGLIYHREEKRWRWINNSVFNGNVTNQNQNFNCATIGLTKTFDAASCDISYRRICEKNAK

SEQ ID NO: 87 - skipped
  Unknown

SEQ ID NO: 88 - protein, 190 aa, Homo sapiens
MNWHMIISGLIVVVIKVVGMTFFLLYFPQVFGKSNDGFVPTESYGTTSVQNVSQIFGRNDESTMPTRSYGTVCPRNWDFHQGKCFFFSFSESPWKDSMDYCATQGSTLAIVNTPEKLKYLQDIAGIENYFIGLVRQPGEKKWRWINNSVFNGNVTNQDQNFDCVTIGLTKTYDAASCEVSYRWICEMNAK

SEQ ID NO: 89 - skipped
  Unknown

SEQ ID NO: 90 - skipped
  Unknown

SEQ ID NO: 91 - DNA, 4018 bp, Homo sapiens
  misc_feature (1)...(4018): n = A,T,C or G
gtggtcgcggccgaggtgagactgtgaagaaggaagaacgttgcttgggcaaaaggagcatattctcaggagacggggcccctgcctgccacaccaagcattaggccaccaggaagacccccatctgcaagcaagcctagccttccagggagaaagaggcccctgcagctccttcatcatgaactggcacatgatcatctctgggcttattgtggtagtgcttaaagttgttggaatgaccttatttctactttatttcccacagatttttaacaaaagtaacgatggtttcaccaccaccaggagctatggaacagtctcacagatttttgggagcagttccccaagtcccaacggcttcattaccacaaggagctatggaacagtctgccccaaagactgggaattttatcaagcaagatgttttttcttatccacttctgaatcatcttggaatgaaagcagggacttttgcaaaggaaaaggatccacattggcaattgtcaacacgccagagaaactgaagtttcttcaggacataactgatgctgagaagtattttattggcttaatttaccatcgtgaagagaaaaggtggcgttggatcaacaactctgtgttcaatggcaagtacgtgaacatgccacagtttcctggggatcttggtttgcttcaaaagaccaaacctgagattgctgggttcaccctggaatagctcaaacgctgacacttgactctgttctgctcttctcctttcttccaacccatctattccctatctgtctaccagtagcggtccttgcccatttgggaaactgagcttctttcttctgcactgggggactggatgctagccatctccaggagacaggatcagttttacggaaacaactcagttagtatagagatgaggtccgcttctgtagtactgagcatttctgactgatcaaaaaggcctagtctgttgacagggtttgttttattttagcctcagagtataccatactactagggagtaactgtagagtgagaaattataaacattatttagggattaccatggtggaagagggataaacataggtcctgtgacttcgtctctgttctcaagggaaccccattcacatgcccctcctaactccacaagcgagggtagcagaggctctcctcagtctgaactaaggcttggccttggggagggctcctagtgctgagcttggagcagcacggacagcagcattgtttatgggaatggagagaggtctgggcaggataggaaccttcttggagacccctttgaagaaaaccaggcagccaagggagccaaacacactagatttctgttcttcagcaaagccctgaagagacacttaagctaaaaattcccttgtcatatttctgaaactccattataacatatgtaactcctttgtaaccaaaatttaggtaagcaggcttcctttgctctgaaggttttgagtacctggctgtatttgttgagtatttttaaaattttggatagtctcttaggcaacaataatcacaatatattcatcccttcagttctggagaaagcctgataccaggcacagcctactgaccccaaggagcctggcactgattggcatcacattgatctagaactggtccagccgccgaagagtaggaaaagagaagggctgctcagggaaacattggctgggggcacggaataagcacatagtaaaaagggaacatcagggtcaaatggaaatcacctgagacaggaaacagggagttcatttggccacactggaagaaaggcaagaaagaggaagacaagtcttggagtaccctggctgttctccacactcacaagacatcagctatactctgcttggtgcataagaaagagaaaagagatgccttttgtgttttgagtaagaataattaaaccataaggaagaccatgtataaaactgatggaaataatagtcaccaaagtacagcacataccattttgtgtctaataacaatgtagcacagtaatgactgtacatgtcattgtatgtataccaaacaagattgttgtaaatcatattttttattacaacactaagttctgcttctgcattcctaggtttcatcatttttggctccttagcatggccacttacaattttttaacatgagataacacatcaggtgtcagaacttgcttgaagggaattaccagaagtaatttgtgtttgagatggggtggaaattggaattatattagtagccggtggagatacaagttctctgactgtgttgggaaaggataagtgctaccgttgagaagggaagaaaggctgagtctaggtggagaaaaatatcaacagaactctagccaaaggcaagccccagaactcagacaacagaaaggaaatcctaatccttctgttttgagaagagagaactgtagttgcttcacttcctatttcatgacagaataactgcaaacttttaagatcaggaaatgtagacatctagtgatttctttagtagacagtttaatttcccccaagattaggagacacttctgtgcaggttctaaaaggagcccaatggcctggggtgggagtggggagtagatagggaatatgtgggatttggtttaagttcatcattgggagagttcctggatccttgcaagcttagataaatgtgatctttattagatagcagtggcatgcttttaaaaaaaaaaggcaatgaaaatttagcaagccactgaatttgagttttcactttgtttctaatatgctgtgtgaatcagtacagttttcttaccctttcttggtcttaatttccttactgataaaatggggtagtaatacctatctcaaaaaattattgcacatattaaataacattcctctatgtatctcaatggcattagacattaggagaagcattttgtggaggatttgaagttgagatcttcatccaagaagtagcttttcaatttgctagaagcttaatgtaggcaagccacttcatttttcagaacttgtttactcatttataatatgggaataaaaatttgtgcaagtcagagaagggtgccttaaaaatgttgtggccaagccacatgagatcaaagacacacttttcatgacctcaaatgtgggcccagcctaggtcagccaacccccatccaacccttagactcacgaacaaatccacctgagatcagcagagccaccctagatcagctgaaactctaagcacaaaaataaaaacttatcactgtaaaaaaaaaaaaaaaaaaaaaagtctctcgtatagcaaaatctaactgatgcaatctccatctggccttcatccttctccctttattgtcctttcgtgtattgttcatccagcaaccaggatgatcttgttaaaacattaaacagattctgtcaykctttmaaaaaaaaaaaagccatgaaattntagcaagccactgaatttgagttttcactttggtttctaatatgctgtgtgaatcagancagktttcttaccctttcttggtcttaatttccttactgataaaatggggtwgtaatacctatctcaaaaaattattgcacatattarataacattcctctatgtatctcaatggcattagacattaggagaagcattttgtggaggatttgaagttgagatcttcatccaagaagtagcttttcaatttgstagaagcttaatgtaggcaagccacttcatttttcagaacttgtttactcatttataatatgggaataaaaatttgtgcaagtcagagaagggtgccttaaaaatgttgtggccaagccacatgagatcaaagacacacttttcatgacctcaaatgtgggcccagcctaggtcagccaacccccatccaacccttagactcacgaacaaatccacctgagatcagcagagccaccctagatcagctgaaactctaagcacaaaaataaaaacttatcactgtaaaaaaaaaaaaaaaaaaaaaa

SEQ ID NO: 92 - DNA, 534 bp, Homo sapiens
atgaactggcacatgatcatctctgggcttattgtggtagtgcttaaagttgttggaatgaccttatttctactttatttcccacagatttttaacaaaagtaacgatggtttcaccaccaccaggagctatggaacagtctcacagatttttgggagcagttccccaagtcccaacggcttcattaccacaaggagctatggaacagtctgccccaaagactgggaattttatcaagcaagatgttttttcttatccacttctgaatcatcttggaatgaaagcagggacttttgcaaaggaaaaggatccacattggcaattgtcaacacgccagagaaactgaagtttcttcaggacataactgatgctgagaagtattttattggcttaatttaccatcgtgaagagaaaaggtggcgttggatcaacaactctgtgttcaatggcaagtacgtgaacatgccacagtttcctggggatcttggtttgcttcaaaagaccaaacctgagattgctgggttcaccctggaa

SEQ ID NO: 93 - protein, 178 aa, Homo sapiens
MNWHMIISGLIVVVLKVVGMTLFLLYFPQIFNKSNDGFTTTRSYGTVSQIFGSSSPSPNGFITTRSYGTVCPKDWEFYQARCFFLSTSESSWNESRDFCKGKGSTLAIVNTPEKLKFLQDITDAEKYFIGLIYHREEKRWRWINNSVFNGKYVNMPQFPGDLGLLQKTKPEIAGFTLE

SEQ ID NO: 94 - protein, 21 aa, Homo sapiens
ISGLIVVVLKVVGMTLFLLYF

SEQ ID NO: 95 - protein, 151 aa, Homo sapiens
PQIFNKSNDGFTTTRSYGTVSQIFGSSSPSPNGFITTRSYGTVCPKDWEFYQARCFFLSTSESSWNESRDFCKGKGSTLAIVNTPEKLKFLQDITDAEKYFIGLIYHREEKRWRWINNSVFNGKYVNMPQFPGDLGLLQKTKPEIAGFTLE

SEQ ID NO: 96 - DNA, 3985 bp, Homo sapiens
  misc_feature (1)...(3985): n = A,T,C or G
gagactgtgaagaaggaagaacgttgcttgggcaaaaggagcatattctcaggagacggggcccctgcctgccacaccaagcattaggccaccaggaagacccccatctgcaagcaagcctagccttccagggagaaagaggcccctgcagctccttcatcatgaactggcacatgatcatctctgggcttattgtggtagtgcttaaagttgttggaatgaccttatttctactttatttcccacagatttttaacaaaagtaacgatggtttcaccaccaccaggagctatggaacagtctgccccaaagactgggaattttatcaagcaagatgttttttcttatccacttctgaatcatcttggaatgaaagcagggacttttgcaaaggaaaaggatccacattggcaattgtcaacacgccagagaaactgaagtttcttcaggacataactgatgctgagaagtattttattggcttaatttaccatcgtgaagagaaaaggtggcgttggatcaacaactctgtgttcaatggcaatgttaccaatcagaatcagaatttcaactgtgcgaccattggcctaacaaagacatttgatgctgcatcatgtgacatcagctaccgcaggatctgtgagaagaatgccaaatgatcacagttccctgtgacaagaactatacttgcaactctttttgaatccatacaggtcgtctggccaatgattcttttacttacctatctgtctaccagtagcggtccttgcccatttgggaaactgagcttctttcttctgcactgggggactggatgctagccatctccaggagacaggatcagttttacggaaacaactcagttagtatagagatgaggtccgcttctgtagtactgagcatttctgactgatcaaaaaggcctagtctgttgacagggtttgttttattttagcctcagagtataccatactactagggagtaactgtagagtgagaaattataaacattatttagggattaccatggtggaagagggataaacataggtcctgtgacttcgtctctgttctcaagggaaccccattcacatgcccctcctaactccacaagcgagggtagcagaggctctcctcagtctgaactaaggcttggccttggggagggctcctagtgctgagcttggagcagcacggacagcagcattgtttatgggaatggagagaggtctgggcaggataggaaccttcttggagacccctttgaagaaaaccaggcagccaagggagccaaacacactagatttctgttcttcagcaaagccctgaagagacacttaagctaaaaattcccttgtcatatttctgaaactccattataacatatgtaactcctttgtaaccaaaatttaggtaagcaggcttcctttgctctgaaggttttgagtacctggctgtatttgttgagtatttttaaaattttggatagtctcttaggcaacaataatcacaatatattcatcccttcagttctggagaaagcctgataccaggcacagcctactgaccccaaggagcctggcactgattggcatcacattgatctagaactggtccagccgccgaagagtaggaaaagagaagggctgctcagggaaacattggctgggggcacggaataagcacatagtaaaaagggaacatcagggtcaaatggaaatcacctgagacaggaaacagggagttcatttggccacactggaagaaaggcaagaaagaggaagacaagtcttggagtaccctggctgttctccacactcacaagacatcagctatactctgcttggtgcataagaaagagaaaagagatgccttttgtgttttgagtaagaataattaaaccataaggaagaccatgtataaaactgatggaaataatagtcaccaaagtacagcacataccattttgtgtctaataacaatgtagcacagtaatgactgtacatgtcattgtatgtataccaaacaagattgttgtaaatcatattttttattacaacactaagttctgcttctgcattcctaggtttcatcatttttggctccttagcatggccacttacaattttttaacatgagataacacatcaggtgtcagaacttgcttgaagggaattaccagaagtaatttgtgtttgagatggggtggaaattggaattatattagtagccggtggagatacaagttctctgactgtgttgggaaaggataagtgctaccgttgagaagggaagaaaggctgagtctaggtggagaaaaatatcaacagaactctagccaaaggcaagccccagaactcagacaacagaaaggaaatcctaatccttctgttttgagaagagagaactgtagttgcttcacttcctatttcatgacagaataactgcaaacttttaagatcaggaaatgtagacatctagtgatttctttagtagacagtttaatttcccccaagattaggagacacttctgtgcaggttctaaaaggagcccaatggcctggggtgggagtggggagtagatagggaatatgtgggatttggtttaagttcatcattgggagagttcctggatccttgcaagcttagataaatgtgatctttattagatagcagtggcatgcttttaaaaaaaaaaggcaatgaaaatttagcaagccactgaatttgagttttcactttgtttctaatatgctgtgtgaatcagtacagttttcttaccctttcttggtcttaatttccttactgataaaatggggtagtaatacctatctcaaaaaattattgcacatattaaataacattcctctatgtatctcaatggcattagacattaggagaagcattttgtggaggatttgaagttgagatcttcatccaagaagtagcttttcaatttgctagaagcttaatgtaggcaagccacttcatttttcagaacttgtttactcatttataatatgggaataaaaatttgtgcaagtcagagaagggtgccttaaaaatgttgtggccaagccacatgagatcaaagacacacttttcatgacctcaaatgtgggcccagcctaggtcagccaacccccatccaacccttagactcacgaacaaatccacctgagatcagcagagccaccctagatcagctgaaactctaagcacaaaaataaaaacttatcactgtaaaaaaaaaaaaaaaaaaaaaagtctctcgtatagcaaaatctaactgatgcaatctccatctggccttcatccttctccctttattgtcctttcgtgtattgttcatccagcaaccaggatgatcttgttaaaacattaaacagattctgtcaykctttmaaaaaaaaaaaagccatgaaattntagcaagccactgaatttgagttttcactttggtttctaatatgctgtgtgaatcagancagktttcttaccctttcttggtcttaatttccttactgataaaatggggtwgtaatacctatctcaaaaaattattgcacatattarataacattcctctatgtatctcaatggcattagacattaggagaagcattttgtggaggatttgaagttgagatcttcatccaagaagtagcttttcaatttgstagaagcttaatgtaggcaagccacttcatttttcagaacttgtttactcatttataatatgggaataaaaatttgtgcaagtcagagaagggtgccttaaaaatgttgtggccaagccacatgagatcaaagacacacttttcatgacctcaaatgtgggcccagcctaggtcagccaacccccatccaacccttagactcacgaacaaatccacctgagatcagcagagccaccctagatcagctgaaactctaagcacaaaaataaaaacttatcactgtaaaaaaaaaaaaaaaaaaaaaa

SEQ ID NO: 97 - DNA, 495 bp, Homo sapiens
atgaactggcacatgatcatctctgggcttattgtggtagtgcttaaagttgttggaatgaccttatttctactttatttcccacagatttttaacaaaagtaacgatggtttcaccaccaccaggagctatggaacagtctgccccaaagactgggaattttatcaagcaagatgttttttcttatccacttctgaatcatcttggaatgaaagcagggacttttgcaaaggaaaaggatccacattggcaattgtcaacacgccagagaaactgaagtttcttcaggacataactgatgctgagaagtattttattggcttaatttaccatcgtgaagagaaaaggtggcgttggatcaacaactctgtgttcaatggcaatgttaccaatcagaatcagaatttcaactgtgcgaccattggcctaacaaagacatttgatgctgcatcatgtgacatcagctaccgcaggatctgtgagaagaatgccaaa

SEQ ID NO: 98 - protein, 165 aa, Homo sapiens
MNWHMIISGLIVVVLKVVGMTLFLLYFPQIFNKSNDGFTTTRSYGTVCPKDWEFYQARCFFLSTSESSWNESRDFCKGKGSTLAIVNTPEKLKFLQDITDAEKYFIGLIYHREEKRWRWINNSVFNGNVTNQNQNFNCATIGLTKTFDAASCDISYRRICEKNAK

SEQ ID NO: 99 - protein, 21 aa, Homo sapiens
ISGLIVVVLKVVGMTLFLLYF

SEQ ID NO: 100 - protein, 138 aa, Homo sapiens
PQIFNKSNDGFTTTRSYGTVCPKDWEFYQARCFFLSTSESSWNESRDFCKGKGSTLAIVNTPEKLKFLQDITDAEKYFIGLIYHREEKRWRWINNSVFNGNVTNQNQNFNCATIGLTKTFDAASCDISYRRICEKNAK

SEQ ID NO: 101 - DNA, 3958 bp, Homo sapiens
  misc_feature (1)...(3958): n = A,T,C or G
gagactgtgaagaaggaagaacgttgcttgggcaaaaggagcatattctcaggagacggggcccctgcctgccacaccaagcattaggccaccaggaagacccccatctgcaagcaagcctagccttccagggagaaagaggcccctgcagctccttcatcatgaactggcacatgatcatctctgggcttattgtggtagtgcttaaagttgttggaatgaccttatttctactttatttcccacagatttttaacaaaagtaacgatggtttcaccaccaccaggagctatggaacagtctgccccaaagactgggaattttatcaagcaagatgttttttcttatccacttctgaatcatcttggaatgaaagcagggacttttgcaaaggaaaaggatccacattggcaattgtcaacacgccagagaaactgaagtttcttcaggacataactgatgctgagaagtattttattggcttaatttaccatcgtgaagagaaaaggtggcgttggatcaacaactctgtgttcaatggcaagtacgtgaacatgccacagtttcctggggatcttggtttgcttcaaaagaccaaacctgagattgctgggttcaccctggaatagctcaaacgctgacacttgactctgttctgctcttctcctttcttccaacccatctattccctatctgtctaccagtagcggtccttgcccatttgggaaactgagcttctttcttctgcactgggggactggatgctagccatctccaggagacaggatcagttttacggaaacaactcagttagtatagagatgaggtccgcttctgtagtactgagcatttctgactgatcaaaaaggcctagtctgttgacagggtttgttttattttagcctcagagtataccatactactagggagtaactgtagagtgagaaattataaacattatttagggattaccatggtggaagagggataaacataggtcctgtgacttcgtctctgttctcaagggaaccccattcacatgcccctcctaactccacaagcgagggtagcagaggctctcctcagtctgaactaaggcttggccttggggagggctcctagtgctgagcttggagcagcacggacagcagcattgtttatgggaatggagagaggtctgggcaggataggaaccttcttggagacccctttgaagaaaaccaggcagccaagggagccaaacacactagatttctgttcttcagcaaagccctgaagagacacttaagctaaaaattcccttgtcatatttctgaaactccattataacatatgtaactcctttgtaaccaaaatttaggtaagcaggcttcctttgctctgaaggttttgagtacctggctgtatttgttgagtatttttaaaattttggatagtctcttaggcaacaataatcacaatatattcatcccttcagttctggagaaagcctgataccaggcacagcctactgaccccaaggagcctggcactgattggcatcacattgatctagaactggtccagccgccgaagagtaggaaaagagaagggctgctcagggaaacattggctgggggcacggaataagcacatagtaaaaagggaacatcagggtcaaatggaaatcacctgagacaggaaacagggagttcatttggccacactggaagaaaggcaagaaagaggaagacaagtcttggagtaccctggctgttctccacactcacaagacatcagctatactctgcttggtgcataagaaagagaaaagagatgccttttgtgttttgagtaagaataattaaaccataaggaagaccatgtataaaactgatggaaataatagtcaccaaagtacagcacataccattttgtgtctaataacaatgtagcacagtaatgactgtacatgtcattgtatgtataccaaacaagattgttgtaaatcatattttttattacaacactaagttctgcttctgcattcctaggtttcatcatttttggctccttagcatggccacttacaattttttaacatgagataacacatcaggtgtcagaacttgcttgaagggaattaccagaagtaatttgtgtttgagatggggtggaaattggaattatattagtagccggtggagatacaagttctctgactgtgttgggaaaggataagtgctaccgttgagaagggaagaaaggctgagtctaggtggagaaaaatatcaacagaactctagccaaaggcaagccccagaactcagacaacagaaaggaaatcctaatccttctgttttgagaagagagaactgtagttgcttcacttcctatttcatgacagaataactgcaaacttttaagatcaggaaatgtagacatctagtgatttctttagtagacagtttaatttcccccaagattaggagacacttctgtgcaggttctaaaaggagcccaatggcctggggtgggagtggggagtagatagggaatatgtgggatttggtttaagttcatcattgggagagttcctggatccttgcaagcttagataaatgtgatctttattagatagcagtggcatgcttttaaaaaaaaaaggcaatgaaaatttagcaagccactgaatttgagttttcactttgtttctaatatgctgtgtgaatcagtacagttttcttaccctttcttggtcttaatttccttactgataaaatggggtagtaatacctatctcaaaaaattattgcacatattaaataacattcctctatgtatctcaatggcattagacattaggagaagcattttgtggaggatttgaagttgagatcttcatccaagaagtagcttttcaatttgctagaagcttaatgtaggcaagccacttcatttttcagaacttgtttactcatttataatatgggaataaaaatttgtgcaagtcagagaagggtgccttaaaaatgttgtggccaagccacatgagatcaaagacacacttttcatgacctcaaatgtgggcccagcctaggtcagccaacccccatccaacccttagactcacgaacaaatccacctgagatcagcagagccaccctagatcagctgaaactctaagcacaaaaataaaaacttatcactgtaaaaaaaaaaaaaaaaaaaaaagtctctcgtatagcaaaatctaactgatgcaatctccatctggccttcatccttctccctttattgtcctttcgtgtattgttcatccagcaaccaggatgatcttgttaaaacattaaacagattctgtcaykctttmaaaaaaaaaaaagccatgaaattntagcaagccactgaatttgagttttcactttggtttctaatatgctgtgtgaatcagancagktttcttaccctttcttggtcttaatttccttactgataaaatggggtwgtaatacctatctcaaaaaattattgcacatattarataacattcctctatgtatctcaatggcattagacattaggagaagcattttgtggaggatttgaagttgagatcttcatccaagaagtagcttttcaatttgstagaagcttaatgtaggcaagccacttcatttttcagaacttgtttactcatttataatatgggaataaaaatttgtgcaagtcagagaagggtgccttaaaaatgttgtggccaagccacatgagatcaaagacacacttttcatgacctcaaatgtgggcccagcctaggtcagccaacccccatccaacccttagactcacgaacaaatccacctgagatcagcagagccaccctagatcagctgaaactctaagcacaaaaataaaaacttatcactgtaaaaaaaaaaaaaaaaaaaaaagaaagcacctgcccgggcggccgccc

SEQ ID NO: 102 - DNA, 465 bp, Homo sapiens
atgaactggcacatgatcatctctgggcttattgtggtagtgcttaaagttgttggaatgaccttatttctactttatttcccacagatttttaacaaaagtaacgatggtttcaccaccaccaggagctatggaacagtctgccccaaagactgggaattttatcaagcaagatgttttttcttatccacttctgaatcatcttggaatgaaagcagggacttttgcaaaggaaaaggatccacattggcaattgtcaacacgccagagaaactgaagtttcttcaggacataactgatgctgagaagtattttattggcttaatttaccatcgtgaagagaaaaggtggcgttggatcaacaactctgtgttcaatggcaagtacgtgaacatgccacagtttcctggggatcttggtttgcttcaaaagaccaaacctgagattgctgggttcaccctggaa

SEQ ID NO: 103 - protein, 155 aa, Homo sapiens
MNWHMIISGLIVVVLKVVGMTLFLLYFPQIFNKSNDGFTTTRSYGTVCPKDWEFYQARCFFLSTSESSWNESRDFCKGKGSTLAIVNTPEKLKFLQDITDAEKYFIGLIYHREEKRWRWINNSVFNGKYVNMPQFPGDLGLLQKTKPEIAGFTLE

SEQ ID NO: 104 - protein, 21 aa, Homo sapiens
ISGLIVVVLKVVGMTLFLLYF

SEQ ID NO: 105 - protein, 128 aa, Homo sapiens
PQIFNKSNDGFTTTRSYGTVCPKDWEFYQARCFFLSTSESSWNESRDFCKGKGSTLAIVNTPEKLKFLQDITDAEKYFIGLIYHREEKRWRWINNSVFNGKYVNMPQFPGDLGLLQKTKPEIAGFTLE

SEQ ID NO: 106 - DNA, 3925 bp, Homo sapiens
  misc_feature (1)...(3925): n = A,T,C or G
gagactgtgaagaaggaagaacgttgcttgggcaaaaggagcatattctcaggagacggggcccctgcctgccacaccaagcattaggccaccaggaagacccccatctgcaagcaagcctagccttccagggagaaagaggcccctgcagctccttcatcatgaactggcacatgatcatctctgggcttattgtggtagtgcttaaagttgttggaatgaccttatttctactttatttctgccccaaagactgggaattttatcaagcaagatgttttttcttatccacttctgaatcatcttggaatgaaagcagggacttttgcaaaggaaaaggatccacattggcaattgtcaacacgccagagaaactgaagtttcttcaggacataactgatgctgagaagtattttattggcttaatttaccatcgtgaagagaaaaggtggcgttggatcaacaactctgtgttcaatggcaatgttaccaatcagaatcagaatttcaactgtgcgaccattggcctaacaaagacatttgatgctgcatcatgtgacatcagctaccgcaggatctgtgagaagaatgccaaatgatcacagttccctgtgacaagaactatacttgcaactctttttgaatccatacaggtcgtctggccaatgattcttttacttacctatctgtctaccagtagcggtccttgcccatttgggaaactgagcttctttcttctgcactgggggactggatgctagccatctccaggagacaggatcagttttacggaaacaactcagttagtatagagatgaggtccgcttctgtagtactgagcatttctgactgatcaaaaaggcctagtctgttgacagggtttgttttattttagcctcagagtataccatactactagggagtaactgtagagtgagaaattataaacattatttagggattaccatggtggaagagggataaacataggtcctgtgacttcgtctctgttctcaagggaaccccattcacatgcccctcctaactccacaagcgagggtagcagaggctctcctcagtctgaactaaggcttggccttggggagggctcctagtgctgagcttggagcagcacggacagcagcattgtttatgggaatggagagaggtctgggcaggataggaaccttcttggagacccctttgaagaaaaccaggcagccaagggagccaaacacactagatttctgttcttcagcaaagccctgaagagacacttaagctaaaaattcccttgtcatatttctgaaactccattataacatatgtaactcctttgtaaccaaaatttaggtaagcaggcttcctttgctctgaaggttttgagtacctggctgtatttgttgagtatttttaaaattttggatagtctcttaggcaacaataatcacaatatattcatcccttcagttctggagaaagcctgataccaggcacagcctactgaccccaaggagcctggcactgattggcatcacattgatctagaactggtccagccgccgaagagtaggaaaagagaagggctgctcagggaaacattggctgggggcacggaataagcacatagtaaaaagggaacatcagggtcaaatggaaatcacctgagacaggaaacagggagttcatttggccacactggaagaaaggcaagaaagaggaagacaagtcttggagtaccctggctgttctccacactcacaagacatcagctatactctgcttggtgcataagaaagagaaaagagatgccttttgtgttttgagtaagaataattaaaccataaggaagaccatgtataaaactgatggaaataatagtcaccaaagtacagcacataccattttgtgtctaataacaatgtagcacagtaatgactgtacatgtcattgtatgtataccaaacaagattgttgtaaatcatattttttattacaacactaagttctgcttctgcattcctaggtttcatcatttttggctccttagcatggccacttacaattttttaacatgagataacacatcaggtgtcagaacttgcttgaagggaattaccagaagtaatttgtgtttgagatggggtggaaattggaattatattagtagccggtggagatacaagttctctgactgtgttgggaaaggataagtgctaccgttgagaagggaagaaaggctgagtctaggtggagaaaaatatcaacagaactctagccaaaggcaagccccagaactcagacaacagaaaggaaatcctaatccttctgttttgagaagagagaactgtagttgcttcacttcctatttcatgacagaataactgcaaacttttaagatcaggaaatgtagacatctagtgatttctttagtagacagtttaatttcccccaagattaggagacacttctgtgcaggttctaaaaggagcccaatggcctggggtgggagtggggagtagatagggaatatgtgggatttggtttaagttcatcattgggagagttcctggatccttgcaagcttagataaatgtgatctttattagatagcagtggcatgcttttaaaaaaaaaaggcaatgaaaatttagcaagccactgaatttgagttttcactttgtttctaatatgctgtgtgaatcagtacagttttcttaccctttcttggtcttaatttccttactgataaaatggggtagtaatacctatctcaaaaaattattgcacatattaaataacattcctctatgtatctcaatggcattagacattaggagaagcattttgtggaggatttgaagttgagatcttcatccaagaagtagcttttcaatttgctagaagcttaatgtaggcaagccacttcatttttcagaacttgtttactcatttataatatgggaataaaaatttgtgcaagtcagagaagggtgccttaaaaatgttgtggccaagccacatgagatcaaagacacacttttcatgacctcaaatgtgggcccagcctaggtcagccaacccccatccaacccttagactcacgaacaaatccacctgagatcagcagagccaccctagatcagctgaaactctaagcacaaaaataaaaacttatcactgtaaaaaaaaaaaaaaaaaaaaaagtctctcgtatagcaaaatctaactgatgcaatctccatctggccttcatccttctccctttattgtcctttcgtgtattgttcatccagcaaccaggatgatcttgttaaaacattaaacagattctgtcaykctttmaaaaaaaaaaaagccatgaaattntagcaagccactgaatttgagttttcactttggtttctaatatgctgtgtgaatcagancagktttcttaccctttcttggtcttaatttccttactgataaaatggggtwgtaatacctatctcaaaaaattattgcacatattarataacattcctctatgtatctcaatggcattagacattaggagaagcattttgtggaggatttgaagttgagatcttcatccaagaagtagcttttcaatttgstagaagcttaatgtaggcaagccacttcatttttcagaacttgtttactcatttataatatgggaataaaaatttgtgcaagtcagagaagggtgccttaaaaatgttgtggccaagccacatgagatcaaagacacacttttcatgacctcaaatgtgggcccagcctaggtcagccaacccccatccaacccttagactcacgaacaaatccacctgagatcagcagagccaccctagatcagctgaaactctaagcacaaaaataaaaacttatcactgtaaaaaaaaaaaaaaaaaaaaaa

SEQ ID NO: 107 - DNA, 435 bp, Homo sapiens
atgaactggcacatgatcatctctgggcttattgtggtagtgcttaaagttgttggaatgaccttatttctactttatttctgccccaaagactgggaattttatcaagcaagatgttttttcttatccacttctgaatcatcttggaatgaaagcagggacttttgcaaaggaaaaggatccacattggcaattgtcaacacgccagagaaactgaagtttcttcaggacataactgatgctgagaagtattttattggcttaatttaccatcgtgaagagaaaaggtggcgttggatcaacaactctgtgttcaatggcaatgttaccaatcagaatcagaatttcaactgtgcgaccattggcctaacaaagacatttgatgctgcatcatgtgacatcagctaccgcaggatctgtgagaagaatgccaaa

SEQ ID NO: 108 - protein, 145 aa, Homo sapiens
MNWHMIISGLIVVVLKVVGMTLFLLYFCPKDWEFYQARCFFLSTSESSWNESRDFCKGKGSTLAIVNTPEKLKFLQDITDAEKYFIGLIYHREEKRWRWINNSVFNGNVTNQNQNFNCATIGLTKTFDAASCDISYRRICEKNAK

SEQ ID NO: 109 - protein, 22 aa, Homo sapiens
ISGLIVVVLKVVGMTLFLLYFC

SEQ ID NO: 110 - protein, 117 aa, Homo sapiens
PKDWEFYQARCFFLSTSESSWNESRDFCKGKGSTLAIVNTPEKLKFLQDITDAEKYFIGLIYHREEKRWRWINNSVFNGNVTNQNQNFNCATIGLTKTFDAASCDISYRRICEKNAK

SEQ ID NO: 111 - DNA, 3898 bp, Homo sapiens
  misc_feature (1)...(3898): n = A,T,C or G
gagactgtgaagaaggaagaacgttgcttgggcaaaaggagcatattctcaggagacggggcccctgcctgccacaccaagcattaggccaccaggaagacccccatctgcaagcaagcctagccttccagggagaaagaggcccctgcagctccttcatcatgaactggcacatgatcatctctgggcttattgtggtagtgcttaaagttgttggaatgaccttatttctactttatttctgccccaaagactgggaattttatcaagcaagatgttttttcttatccacttctgaatcatcttggaatgaaagcagggacttttgcaaaggaaaaggatccacattggcaattgtcaacacgccagagaaactgaagtttcttcaggacataactgatgctgagaagtattttattggcttaatttaccatcgtgaagagaaaaggtggcgttggatcaacaactctgtgttcaatggcaagtacgtgaacatgccacagtttcctggggatcttggtttgcttcaaaagaccaaacctgagattgctgggttcaccctggaatagctcaaacgctgacacttgactctgttctgctcttctcctttcttccaacccatctattccctatctgtctaccagtagcggtccttgcccatttgggaaactgagcttctttcttctgcactgggggactggatgctagccatctccaggagacaggatcagttttacggaaacaactcagttagtatagagatgaggtccgcttctgtagtactgagcatttctgactgatcaaaaaggcctagtctgttgacagggtttgttttattttagcctcagagtataccatactactagggagtaactgtagagtgagaaattataaacattatttagggattaccatggtggaagagggataaacataggtcctgtgacttcgtctctgttctcaagggaaccccattcacatgcccctcctaactccacaagcgagggtagcagaggctctcctcagtctgaactaaggcttggccttggggagggctcctagtgctgagcttggagcagcacggacagcagcattgtttatgggaatggagagaggtctgggcaggataggaaccttcttggagacccctttgaagaaaaccaggcagccaagggagccaaacacactagatttctgttcttcagcaaagccctgaagagacacttaagctaaaaattcccttgtcatatttctgaaactccattataacatatgtaactcctttgtaaccaaaatttaggtaagcaggcttcctttgctctgaaggttttgagtacctggctgtatttgttgagtatttttaaaattttggatagtctcttaggcaacaataatcacaatatattcatcccttcagttctggagaaagcctgataccaggcacagcctactgaccccaaggagcctggcactgattggcatcacattgatctagaactggtccagccgccgaagagtaggaaaagagaagggctgctcagggaaacattggctgggggcacggaataagcacatagtaaaaagggaacatcagggtcaaatggaaatcacctgagacaggaaacagggagttcatttggccacactggaagaaaggcaagaaagaggaagacaagtcttggagtaccctggctgttctccacactcacaagacatcagctatactctgcttggtgcataagaaagagaaaagagatgccttttgtgttttgagtaagaataattaaaccataaggaagaccatgtataaaactgatggaaataatagtcaccaaagtacagcacataccattttgtgtctaataacaatgtagcacagtaatgactgtacatgtcattgtatgtataccaaacaagattgttgtaaatcatattttttattacaacactaagttctgcttctgcattcctaggtttcatcatttttggctccttagcatggccacttacaattttttaacatgagataacacatcaggtgtcagaacttgcttgaagggaattaccagaagtaatttgtgtttgagatggggtggaaattggaattatattagtagccggtggagatacaagttctctgactgtgttgggaaaggataagtgctaccgttgagaagggaagaaaggctgagtctaggtggagaaaaatatcaacagaactctagccaaaggcaagccccagaactcagacaacagaaaggaaatcctaatccttctgttttgagaagagagaactgtagttgcttcacttcctatttcatgacagaataactgcaaacttttaagatcaggaaatgtagacatctagtgatttctttagtagacagtttaatttcccccaagattaggagacacttctgtgcaggttctaaaaggagcccaatggcctggggtgggagtggggagtagatagggaatatgtgggatttggtttaagttcatcattgggagagttcctggatccttgcaagcttagataaatgtgatctttattagatagcagtggcatgcttttaaaaaaaaaaggcaatgaaaatttagcaagccactgaatttgagttttcactttgtttctaatatgctgtgtgaatcagtacagttttcttaccctttcttggtcttaatttccttactgataaaatggggtagtaatacctatctcaaaaaattattgcacatattaaataacattcctctatgtatctcaatggcattagacattaggagaagcattttgtggaggatttgaagttgagatcttcatccaagaagtagcttttcaatttgctagaagcttaatgtaggcaagccacttcatttttcagaacttgtttactcatttataatatgggaataaaaatttgtgcaagtcagagaagggtgccttaaaaatgttgtggccaagccacatgagatcaaagacacacttttcatgacctcaaatgtgggcccagcctaggtcagccaacccccatccaacccttagactcacgaacaaatccacctgagatcagcagagccaccctagatcagctgaaactctaagcacaaaaataaaaacttatcactgtaaaaaaaaaaaaaaaaaaaaaagtctctcgtatagcaaaatctaactgatgcaatctccatctggccttcatccttctccctttattgtcctttcgtgtattgttcatccagcaaccaggatgatcttgttaaaacattaaacagattctgtcaykctttmaaaaaaaaaaaagccatgaaattntagcaagccactgaatttgagttttcactttggtttctaatatgctgtgtgaatcagancagktttcttaccctttcttggtcttaatttccttactgataaaatggggtwgtaatacctatctcaaaaaattattgcacatattarataacattcctctatgtatctcaatggcattagacattaggagaagcattttgtggaggatttgaagttgagatcttcatccaagaagtagcttttcaatttgstagaagcttaatgtaggcaagccacttcatttttcagaacttgtttactcatttataatatgggaataaaaatttgtgcaagtcagagaagggtgccttaaaaatgttgtggccaagccacatgagatcaaagacacacttttcatgacctcaaatgtgggcccagcctaggtcagccaacccccatccaacccttagactcacgaacaaatccacctgagatcagcagagccaccctagatcagctgaaactctaagcacaaaaataaaaacttatcactgtaaaaaaaaaaaaaaaaaaaaaagaaagcacctgcccgggcggccgccc

SEQ ID NO: 112 - DNA, 405 bp, Homo sapiens
atgaactggcacatgatcatctctgggcttattgtggtagtgcttaaagttgttggaatgaccttatttctactttatttctgccccaaagactgggaattttatcaagcaagatgttttttcttatccacttctgaatcatcttggaatgaaagcagggacttttgcaaaggaaaaggatccacattggcaattgtcaacacgccagagaaactgaagtttcttcaggacataactgatgctgagaagtattttattggcttaatttaccatcgtgaagagaaaaggtggcgttggatcaacaactctgtgttcaatggcaagtacgtgaacatgccacagtttcctggggatcttggtttgcttcaaaagaccaaacctgagattgctgggttcaccctggaa

SEQ ID NO: 113 - protein, 135 aa, Homo sapiens
MNWHMIISGLIVVVLKVVGMTLFLLYFCPKDWEFYQARCFFLSTSESSWNESRDFCKGKGSTLAIVNTPEKLKFLQDITDAEKYFIGLIYHREEKRWRWINNSVFNGKYVNMPQFPGDLGLLQKTKPEIAGFTLE

SEQ ID NO: 114 - protein, 22 aa, Homo sapiens
ISGLIVVVLKVVGMTLFLLYFC

SEQ ID NO: 115 - protein, 107 aa, Homo sapiens
PKDWEFYQARCFFLSTSESSWNESRDFCKGKGSTLAIVNTPEKLKFLQDITDAEKYFIGLIYHREEKRWRWINNSVFNGKYVNMPQFPGDLGLLQKTKPEIAGFTLE

SEQ ID NO: 116 - skipped
  Unknown

SEQ ID NO: 117 - skipped
  Unknown

SEQ ID NO: 118 - skipped
  Unknown

SEQ ID NO: 119 - skipped
  Unknown

SEQ ID NO: 120 - skipped
  Unknown

SEQ ID NO: 121 - DNA, 1909 bp, Homo sapiens
gctgtttcttggtggtgttggaatggtgggcacagtggctgtcactgtcatgcctcagtggagagtgtcggccttcattgaaaacaacatcgtggtttttgaaaacttctgggaaggactgtggatgaattgcgtgaggcaggctaacatcaggatgcagtgcaaaatctatgattccctgctggctctttctccggacctacaggcagccagaggactgatgtgtgctgcttccgtgatgtccttcttggctttcatgatggccatccttggcatgaaatgcaccaggtgcacgggggacaatgagaaggtgaaggctcacattctgctgacggctggaatcatcttcatcatcacgggcatggtggtgctcatccctgtgagctgggttgccaatgccatcatcagagatttctataactcaatagtgaatgttgcccaaaaacgtgagcttggagaagctctctacttaggatggaccacggcactggtgctgattgttggaggagctctgttctgctgcgttttttgttgcaacgaaaagagcagtagctacagatactcgataccttcccatcgcacaacccaaaaaagttatcacaccggaaagaagtcaccgagcgtctactccagaagtcagtatgtgtagttgtgtatgtttttttaactttactataaagccatgcaaatgacaaaaatctatattactttctcaaaatggaccccaaagaaactttgatttactgttcttaactgcctaatcttaattacaggaactgtgcatcagctatttatgattctataagctatttcagcagaatgagatattaaacccaatgctttgattgttctagaaagtatagtaatttgttttctaaggtggttcaagcatctactctttttatcatttacttcaaaatgacattgctaaagactgcattattttactactgtaatttctccacgacatagcattatgtacatagatgagtgtaacatttatatctcacatagagacatgcttatatggttttatttaaaatgaaatgccagtccattacactgaataaatagaactcaactattgcttttcagggaaatcatggatagggttgaagaaggttactattaattgtttaaaaacagcttagggattaatgtcctccatttataatgaagattaaaatgaaggctttaatcagcattgtaaaggaaattgaatggctttctgatatgctgttttttagcctaggagttagaaatcctaacttctttatcctcttctcccagaggctttttttttcttgtgtattaaattaacatttttaaaaagcagatattttgtcaaggggctttgcattcaaactgcttttccagggctatactcagaagaaagataaaagtgtgatctaagaaaaagtgatggttttaggaaagtgaaaatatttttgtttttgtatttgaagaagaatgatgcattttgacaagaaatcatatatgtatggatatattttaataagtatttgagtacagactttgaggtttcatcaatataaataaaagagcagaaaaatatgtcttggttttcatttgcttaccaaaaaaacaacaacaaaaaaagttgtcctttgagaacttcacctgctcctatgtgggtacctgagtcaaaattgtcatttttgttctgtgaaaaataaatttccttcttgtaccatttctgtttagttttactaaaatctgtaaatactgtatttttctgtttattccaaatttgatgaaactgacaatccaatttgaaagtttgtgtcgacgtctgtctagcttaaatgaatgtgttctatttgctttatacatttatattaataaattgtacatttttctaaaaaaaaaaaaaaaaaaaaaaaaaaaa

SEQ ID NO: 122 - DNA, 645 bp, Homo sapiens
ctgtttcttggtggtgttggaatggtgggcacagtggctgtcactgtcatgcctcagtggagagtgtcggccttcattgaaaacaacatcgtggtttttgaaaacttctgggaaggactgtggatgaattgcgtgaggcaggctaacatcaggatgcagtgcaaaatctatgattccctgctggctctttctccggacctacaggcagccagaggactgatgtgtgctgcttccgtgatgtccttcttggctttcatgatggccatccttggcatgaaatgcaccaggtgcacgggggacaatgagaaggtgaaggctcacattctgctgacggctggaatcatcttcatcatcacgggcatggtggtgctcatccctgtgagctgggttgccaatgccatcatcagagatttctataactcaatagtgaatgttgcccaaaaacgtgagcttggagaagctctctacttaggatggaccacggcactggtgctgattgttggaggagctctgttctgctgcgttttttgttgcaacgaaaagagcagtagctacagatactcgataccttcccatcgcacaacccaaaaaagttatcacaccggaaagaagtcaccgagcgtctactccagaagtcagtatgtg

SEQ ID NO: 123 - protein, 215 aa, Homo Sapiens
LFLGGVGMVGTVAVTVMPQWRVSAFIENNIVVFENFWEGLWMNCVRQANIRMQCKIYDSLLALSPDLQAARGLMCAASVMSFLAFMMAILGMKCTRCTGDNEKVKAHILLTAGIIFIITGMVVLIPVSWVANAIIRDFYNSIVNVAQKRELGEALYLGWTTALVLIVGGALFCCVFCCNEKSSSYRYSIPSHRTTQKSYHTGKKSPSVYSRSQYV

SEQ ID NO: 124 - protein, 24 aa, Homo sapiens
LFLGGVGMVGTVAVTVMPQWRVSA

SEQ ID NO: 125 - protein, 47 aa, Homo sapiens
FIENNIVVFENFWEGLWMNCVRQANIRMQCKIYDSLLALSPDLQAAR

SEQ ID NO: 126 - protein, 21 aa, Homo sapiens
GLMCAASVMSFLAFMMAILGM

SEQ ID NO: 127 - protein, 15 aa, Homo sapiens
KCTRCTGDNEKVKAH

SEQ ID NO: 128 - protein, 24 aa, Homo sapiens
ILLTAGIIFIITGMVVLIPVSWVA

SEQ ID NO: 129 - protein, 22 aa, Homo sapiens
NAIIRDFYNSIVNVAQKRELGE

SEQ ID NO: 130 - protein, 25 aa, Homo sapiens
ALYLGWTTALVLIVGGALFCCVFCC

SEQ ID NO: 131 - protein, 37 aa, Homo sapiens
NEKSSSYRYSIPSHRTTQKSYHTGKKSPSVYSRSQYV

SEQ ID NO: 132 - protein, 225 aa, Mus sp.
MATYALQMAALVLGGVGMVGTVAVTIMPQWRVSAFIESNIVVFENRWEGLWMNCMRHANIRMQCKVYDSLLALSPDLQASRGLMCAASVLAFLAFMTAILGMKCTRCTGDDENVKSRILLTAGIIFFITGLVVLIPVSWVANSIIRDFYNPLVDVALKRELGEALYIGWTTALVLIAGGALFCCVFCCTERSNSYRYSVPSHRTTQRSFHAEKRSPSIYSKSQYV

SEQ ID NO: 133 - protein, 678 aa, Mus sp.
ATGGCAACCTACGCTCTTCAAATGGCTGCACTGGTGCTTGGTGGTGTTGGCATGGTGGGCACGGTGGCTGTGACTATCATGCCTCAGTGGAGAGTGTCTGCCTTCATCGAAAGTAACATTGTGGTGTTTGAGAACCGCTGGGAAGGCTTGTGGATGAATTGTATGAGGCATGCCAACATCAGAATGCAGTGCAAGGTCTACGACTCCCTGCTGGCTCTTAGTCCAGACCTCCAGGCATCCCGAGGACTGATGTGTGCTGCGTCCGTCTTGGCTTTCTTGGCTTTCATGACAGCCATCCTCGGAATGAAGTGCACCAGATGCACGGGGGACGATGAGAACGTGAAGAGCCGCATCTTGCTGACAGCCGGAATCATCTTCTTCATCACCGGCTTGGTTGTGCTCATCCCTGTCAGCTGGGTTGCCAATTCCATCATCAGAGACTTCTACAACCCACTGGTGGATGTGGCCCTAAAGCGCGAGCTGGGAGAAGCCCTCTACATAGGCTGGACCACAGCGCTGGTGCTGATCGCTGGAGGAGCACTGTTCTGTTGTGTGTTTTGTTGTACTGAAAGGAGCAACAGTTACAGGTACTCGGTACCATCCCATCGCACCACTCAACGGAGTTTCCACGCCGAAAAGAGATCTCCGAGCATATACTCCAAAAGTCAGTATGTGTAG

SEQ ID NO: 134 - protein, 1090 aa, Homo sapiens
GGGGCAGAATGAGATATTAAACCCAATGCTTTGATTGTTCTAGAAAGTATAGTAATTTGTTTTCTAAGGTGGTTCAAGCATCTACTCTTTTTATCATTTACTTCAAAATGACATTGCTAAAGACTGCATTATTTTACTACTGTAATTTCTCCACGACATAGCATTATGTACATAGATGAGTGTAACATTTATATCTCACATAGAGACATGCTTATATGGTTTTATTTAAAATGAAATGCCAGTCCATTACACTGAATAAATAGAACTCAACTATTGCTTTTCAGGGAAATCATGGATAGGGTTGAAGAAGGTTACTATTAATTGTTTTAAAAACAGCTTAGGGATTAATGTCCTCCATTTATAATGAAGATTAAAATGAAGGCTTTAATCAGCATTGTAAAGGAAATTGAATGGCTTTCTGATATGCTGTTTTTTAGCCTAGGAGTTAGAAATCCTAACTTCTTTATCCTCTTCTCCCAGAGGCTTTTTTTTTCTTGTGTATTAAATTAACATTTTTAAAAAGCAGATATTTTGTCAAGGGGCTTTGCATTCAAACTGCTTTTCCAGGGCTATACTCAGAAGAAAGATAAAAGTGTGATCTAAGAAAAAGTGATGGTTTTAGGAAAGTGAAAATATTTTTGTTTTTGTATTTGAAGAAGAATGATGCATTTTGACAAGAAATCATATATGTATGGATATATTTTAATAAGTATTTGAGTACAGACTTTGAGGTTTCATCAATATAAATAAAAGAGCAGAAAAATATGTCTTGGTTTTCATTTGCTTACCAAAAAAACAACAACAAAAAAAGTTGTCCTTTGAGAACTTCACCTGCTCCTATGTGGGTACCTGAGTCAAAATTGTCATTTTTGTTCTGTGAAAAATAAATTTCCTTCTTGTACCATTTCTGTTTAGTTTTACTAAAATCTGTAAATACTGTATTTTTCTGTTTATTCCAAATTTGATGAAACTGACAATCCAATTTGAAAGTTTGTGTCGACGTCTGTCTAGCTTAAATGAATGTGTTCTATTTGCTTTATACATTTATATTAATAAATTGTACATTTTTCCAAAAAAAAAAAAAAAAAAA

SEQ ID NO: 135 - protein, 209 aa, Homo sapiens
MASMGLQVMGIALAVLGWLAVMLCCALPMWRVTAFIGSNIVTSQTIWEGLWMNCVVQSTGQMQCKVYDSLLALPQDLQAARALVIISIIVAALGVLLSVVGGKCTNCLEDESAKAKTMIVAGVVFLLAGLMVIVPVSWTAHNIIQDFYNPLVASGQKREMGASLYVGWAASGLLLLGGGLLCCNCPPRTDKPYSAKYSAARSAAASNYV

SEQ ID NO: 136 - protein, 210 aa, Mus sp.
MASMGLQVLGISLAVLGWLGIILSCALPMWRVTAFIGSNIVTAQTSWEGLWMNCVVQSTGQMQCKMYDSMLALPQDLQAARALMVISIIVGALGMLLSVVGGKCTNCMEDETVKAKIMITAGAVFIVASMLIMVPVSWTAHNVIRDFYNPMVASGQKREMGASLYVGWAASGLLLLGGGLLCCSCPPRSNDKPYSAKYSAARSVPASNYV

SEQ ID NO: 137 - protein, 248 aa, Rattus sp.
MSMSLEITGTSLAVLGWLCTIVCCALPMWRVSAFIGSSIITAQITWEGLWMNCVQSTGQMQCKMYDSLLALPQDLQAARALIVVSILLAAFGLLVALVGAQCTNCVQDETAKAKITIVAGVLFLLAAVLTLVPVSWSANTIIRDFYNPLVPEAQKREMGTGLYVGWAAAALQLLGGALLCCSCPPREKYAPTKILYSAPRSTGPGTGTGTAYDRKTTSERPGARTPHHHHYQPSMYPTRPACSLASET

SEQ ID NO: 138 - protein, 191 aa, Homo sapiens
FIENNIVVFENFWEGLWMNCVRQANIRMQCKIYDSLLALSPDLQAARGLMCAASVMSFLAFMMAILGMKCTRCTGDNEKVKAHILLTAGIIFIITGMVVLIPVSWVANAIIRDFYNSIVNVAQKRELGEALYLGWTTALVLIVGGALFCCVFCCNEKSSSYRYSIPSHRTTQKSYHTGKKSPSVYSRSQYV

SEQ ID NO: 139 - skipped
  Unknown

SEQ ID NO: 140 - skipped
  Unknown

SEQ ID NO: 141 - DNA, 323 bp, Homo sapiens
cgagcggccgcccgggcaggtcagacatgggccaaggagccagaggccgtccggggtctgtgagttgagcttgaggccgcaggatgagggtcatcatggggatagccagcctggggttcctctgggcagtattcctgcttcctcttgtgtttggggtccccacagaggagactacctttggagaatctgtggcctcccatctccccaaaggctgtcgacgatgctgtgaccccgaggacctgatgtcctctgatgatacggtccaggcccctgtttccccttatgtcctgcctgaagtcaggccgtacctcggccgcgaccac

SEQ ID NO: 142 - DNA, 240 bp, Homo sapiens
atgagggtcatcatggggatagccagcctggggttcctctgggcagtattcctgcttcctcttgtgtttggggtccccacagaggagactacctttggagaatctgtggcctcccatctccccaaaggctgtcgacgatgctgtgaccccgaggacctgatgtcctctgatgatacggtccaggcccctgtttccccttatgtcctgcctgaagtcaggccgtacctcggccgcgaccac

SEQ ID NO: 143 - protein, 80 aa, Homo sapiens
MRVIMGIASLGFLWAVFLLPLVFGVPTEETTFGESVASHLPKGCRRCCDPEDLMSSDDTVQAPVSPYVLPEVRPYLGRDH

SEQ ID NO: 144 - protein, 24 aa, Homo sapiens
MRVIMGIASLGFLWAVFLLPLVFG

SEQ ID NO: 145 - protein, 56 aa, Homo sapiens
VPTEETTFGESVASHLPKGCRRCCDPEDLMSSDDTVQAPVSPYVLPEVRPYLGRDH

SEQ ID NO: 146 - skipped
  Unknown

SEQ ID NO: 147 - skipped
  Unknown

SEQ ID NO: 148 - skipped
  Unknown

SEQ ID NO: 149 - skipped
  Unknown

SEQ ID NO: 150 - skipped
  Unknown

SEQ ID NO: 151 - DNA, 546 bp, Homo sapiens
cggacgcgtgggcggacgcgtggggttatttctttggttgttaggtataatatgggcatttaaaaacaacacccagttttgtacttgtataagtatggaattcttatataggattgttgttggattcattcttatctttacattttttaatattaagggacagaataccaagtgtccaatgtcttgttattatattgttagggtactgggcactttggggatattgactgtattctgggtttgccccctcactatttttaatccagactattttatacctatcagtataactatagttcttactcttcttcttggaattctttttcttattgtttattatgggagttttcacccaaacagaagtgcagaaacaaaatgtgatgaaattgatggaaaaccagttctaagagaatgtagaatgagatatttcctaatggaataagctattcatttatgatatatattttcttatattttgtttcattggttagtaaagaaaatgtgtgttaaaaaaaaaaaaaaaaaaaaaaaaaaaaaaaaaaaaaa

SEQ ID NO: 152 - DNA, 345 bp, Homo sapiens
atggaattcttatataggattgttgttggattcattcttatctttacattttttaatattaagggacagaataccaagtgtccaatgtcttgttattatattgttagggtactgggcactttggggatattgactgtattctgggtttgccccctcactatttttaatccagactattttatacctatcagtataactatagttcttactcttcttcttggaattctttttcttattgtttattatgggagttttcacccaaacagaagtgcagaaacaaaatgtgatgaaattgatggaaaaccagttctaagagaatgtagaatgagatatttcctaatggaa

SEQ ID NO: 153 - protein, 115 aa, Homo sapiens
MEFLYRIVVGFILIFTFFNIKGQNTKCPMSCYYIVRVLGTLGILTVFWVCPLTIFNPDYFIPISITIVLTLLLGILFLIVYYGSFHPNRSAETKCDEIDGKPVLRECRMRYFLME

SEQ ID NO: 154 - protein, 22 aa, Homo sapiens
MEFLYRIVVGFILIFTFFNIKG

SEQ ID NO: 155 - protein, 93 aa, Homo sapiens
QNTKCPMSCYYIVRVLGTLGILTVFWVCPLTIFNPDYFIPISITIVLTLLLGILFLIVYYGSFHPNRSAETKCDEIDGKPVLRECRMRYFLME

SEQ ID NO: 156 - protein, 9 aa, Homo sapiens
QNTKCPMSC

SEQ ID NO: 157 - protein, 18 aa, Homo sapiens
YYIVRVLGTLGILTVFWV

SEQ ID NO: 158 - protein, 9 aa, Homo sapiens
CPLTIFNPD

SEQ ID NO: 159 - protein, 24 aa, Homo sapiens
YFIPISITIVLTLLLGILFLIVYY

SEQ ID NO: 160 - protein, 33 aa, Homo sapiens
GSFHPNRSAETKCDEIDGKPVLRECRMRYFLME

SEQ ID NO: 161 - skipped
  Unknown

SEQ ID NO: 162 - skipped
  Unknown

SEQ ID NO: 163 - skipped
  Unknown

SEQ ID NO: 164 - skipped
  Unknown

SEQ ID NO: 165 - skipped
  Unknown

SEQ ID NO: 166 - skipped
  Unknown

SEQ ID NO: 167 - skipped
  Unknown

SEQ ID NO: 168 - skipped
  Unknown

SEQ ID NO: 169 - skipped
  Unknown

SEQ ID NO: 170 - skipped
  Unknown

SEQ ID NO: 171 - DNA, 1684 bp, Homo sapiens
cggacgcggtgggcggacgcgtgggcagctgaagaaagagaggaatgaagcgccttctgcttctgtttttgttctttataacattttcttctgcatttcccttagtccggatgacggaaaatgaagaaaatatgcaactggctcaggcatatctcaaccagttctactctcttgaaatagaagggaatcatcttgttcaaagcaagaataggagtctcatagatgacaaaattcgggaaatgcaagcattttttggattgacagtgactggaaaactggactcaaacacccttgagatcatgaagacacccaggtgtggggtgcctgatgtgggccagtatggctacaccctccctgggtggagaaaatacaacctcacctacagaataataaactatactccggatatggcacgagctgctgtggatgaggctatccaagaaggtttagaagtgtggagcaaagtcactccactaaaattcaccaagatttcaaaggggattgcagacatcatgattgcctttaggactcgagtccatggtcggtgtcctcgctattttgatggtcccttgggagtgcttggccatgcctttcctcctggtccgggtctgggtggtgacactcattttgatgaggatgaaaactggaccaaggatggagcaggattcaacttgtttcttgtggctgctcatgaatttggtcatgcactggggctctctcactccaatgatcaaacagccttgatgttcccaaattatgtctccctggatcccagaaaatacccactttctcaggatgatatcaatggaatccagtccatctatggaggtctgcctaaggtacctgctaagccaaaggaacccactataccccatgcctgtgaccctgacttgacttttgacgctatcacaactttccgcagagaagtaatgttctttaaaggcaggcacctatggaggatctattatgatatcacggatgttgagtttgaattaattgcttcattctggccatctctgccagctgatctgcaagctgcatacgagaaccccagagataagattctggtttttaaagatgaaaacttctggatgatcagaggatatgctgtcttgccagattatcccaaatccatccatacattaggttttccaggacgtgtgaagaaaatagatgcagccgtctgtgataagaccacaagaaaaacctacttctttgtgggcatttggtgctggaggtttgatgaaatgacccaaaccatggacaaaggattcccgcagagagtggtaaaacactttcctggaatcagtatccgtgttgatgctgctttccagtacaaaggattcttctttttcagccgtggatcaaagcaatttgaatacaacattaagacaaagaatattacccgaatcatgagaactaatacttggtttcaatgcaaagaaccaaagaactcctcatttggttttgatatcaacaaggaaaaagcacattcaggaggcataaagatattgtatcataagagtttaagcttgtttatttttggtattgttcatttgctgaaaaacacttctatttatcaataaattcatagacctaaaataaacctcaacaggtcttttaatataaattctgcttcaaaatagaataaaaccattctttaacaacaaaaaaaaaaaaaaaa

SEQ ID NO: 172 - DNA, 1542 bp, Homo sapiens
atgaagcgccttctgcttctgtttttgttctttataacattttcttctgcatttcccttagtccggatgacggaaaatgaagaaaatatgcaactggctcaggcatatctcaaccagttctactctcttgaaatagaagggaatcatcttgttcaaagcaagaataggagtctcatagatgacaaaattcgggaaatgcaagcattttttggattgacagtgactggaaaactggactcaaacacccttgagatcatgaagacacccaggtgtggggtgcctgatgtgggccagtatggctacaccctccctgggtggagaaaatacaacctcacctacagaataataaactatactccggatatggcacgagctgctgtggatgaggctatccaagaaggtttagaagtgtggagcaaagtcactccactaaaattcaccaagatttcaaaggggattgcagacatcatgattgcctttaggactcgagtccatggtcggtgtcctcgctattttgatggtcccttgggagtgcttggccatgcctttcctcctggtccgggtctgggtggtgacactcattttgatgaggatgaaaactggaccaaggatggagcaggattcaacttgtttcttgtggctgctcatgaatttggtcatgcactggggctctctcactccaatgatcaaacagccttgatgttcccaaattatgtctccctggatcccagaaaatacccactttctcaggatgatatcaatggaatccagtccatctatggaggtctgcctaaggtacctgctaagccaaaggaacccactataccccatgcctgtgaccctgacttgacttttgacgctatcacaactttccgcagagaagtaatgttctttaaaggcaggcacctatggaggatctattatgatatcacggatgttgagtttgaattaattgcttcattctggccatctctgccagctgatctgcaagctgcatacgagaaccccagagataagattctggtttttaaagatgaaaacttctggatgatcagaggatatgctgtcttgccagattatcccaaatccatccatacattaggttttccaggacgtgtgaagaaaatagatgcagccgtctgtgataagaccacaagaaaaacctacttctttgtgggcatttggtgctggaggtttgatgaaatgacccaaaccatggacaaaggattcccgcagagagtggtaaaacactttcctggaatcagtatccgtgttgatgctgctttccagtacaaaggattcttctttttcagccgtggatcaaagcaatttgaatacaacattaagacaaagaatattacccgaatcatgagaactaatacttggtttcaatgcaaagaaccaaagaactcctcatttggttttgatatcaacaaggaaaaagcacattcaggaggcataaagatattgtatcataagagtttaagcttgtttatttttggtattgttcatttgctgaaaaacacttctatttatcaataa

SEQ ID NO: 173 - protein, 513 aa, Homo sapiens [sequence omitted]

SEQ ID NO: 174 - protein, 17 aa, Homo sapiens
MKRLLLLFLFFITFSSA

SEQ ID NO: 175 - protein, 291 aa, Homo sapiens
FPLVRMTENEENMQLAQAYLNQFYSLEIEGNHLVQSKNRSLIDDKIREMQAFFGLTVTGKLDSNTLEIMKTPRCGVPDVGQYGYTLPGWRKYNLTYRIINYTPDMARAAVDEAIQEGLEVWSKVTPLKFTKISKGIADIMIAFRTRVHGRCPRYFDGPLGVLGHAFPPGPGLGGDTHFDEDENWTKDGAGFNLFLVAAHEFGHALGLSHSNDQTALMFPNYVSLDPRKYPLSQDDINGIQSIYGGLPKVPAKPKEPTIPHACDPDLTFDAITTFRREVMFFKGRHLWRIYY

SEQ ID NO: 176 - protein, 467 aa, Homo sapiens [sequence omitted]

SEQ ID NO: 177 - protein, 1401 aa, Homo sapiens
ATGTTCTCCCTGAAGACGCTTCCATTTCTGCTCTTACTCCATGTGCAGATTTCCAAGGCCTTTCCTGTATCTTCTAAAGAGAAAAATACAAAAACTGTTCAGGACTACCTGGAAAAGTTCTACCAATTACCAAGCAACCAGTATCAGTCTACAAGGAAGAATGGCACTAATGTGATCGTTGAAAAGCTTAAAGAAATGCAGCGATTTTTTGGGTTGAATGTGACGGGGAAGCCAAATGAGGAAACTCTGGACATGATGAAAAAGCCTCGCTGTGGAGTGCCTGACAGTGGTGGTTTTATGTTAACCCCAGGAAACCCCAAGTGGGAACGCACTAACTTGACCTACAGGATTCGAAACTATACCCCACAGCTGTCAGAGGCTGAGGTAGAAAGAGCTATCAAGGATGCCTTTGAACTCTGGAGTGTTGCATCACCTCTCATCTTCACCAGGATCTCACAGGGAGAGGCAGATATCAACATTGCTTTTTACCAAAGAGATCACGGTGACAATTCTCCATTTGATGGACCCAATGGAATCCTTGCTCATGCCTTTCAGCCAGGCCAAGGTATTGGAGGAGATGCTCATTTTGATGCCGAAGAAACATGGACCAACACCTCCGCAAATTACAACTTGTTTCTTGTTGCTGCTCATGAATTTGGCCATTCTTTGGGGCTCGCTCACTCCTCTGACCCTGGTGCCTTGATGTATCCCAACTATGCTTTCAGGGAAACCAGCAACTACTCACTCCCTCAAGATGACATCGATGGCATTCAGGCCATCTATGGACTTTCAAGCAACCCTATCCAACCTACTGGACCAAGCACACCCAAACCCTGTGACCCCAGTTTGACATTTGATGCTATCACCACACTCCGTGGAGAAATACTTTTCTTTAAAGACAGGTACTTCTGGAGAAGGCATCCTCAGCTACAAAGAGTCGAAATGAATTTTATTTCTCTATTCTGGCCATCCCTTCCAACTGGTATACAGGCTGCTTATGAAGATTTTGACAGAGACCTCATTTTCCTATTTAAAGGCAACCAATACTGGGCTCTGAGTGGCTATGATATTCTGCAAGGTTATCCCAAGGATATATCAAACTATGGCTTCCCCAGCAGCGTCCAAGCAATTGACGCAGCTGTTTTCTACAGAAGTAAAACATACTTCTTTGTAAATGACCAATTCTGGAGATATGATAACCAAAGACAATTCATGGAGCCAGGTTATCCCAAAAGCATATCAGGTGCCTTTCCAGGAATAGAGAGTAAAGTTGATGCAGTTTTCCAGCAAGAACATTTCTTCCATGTCTTCAGTGGACCAAGATATTACGCATTTGATCTTATTGCTCAGAGAGTTACCAGAGTTGCAAGAGGCAATAAATGGCTTAACTGTAGATATGGC

SEQ ID NO: 178 - protein, 471 aa, Homo sapiens
FPLVRMTENEENMQLAQAYLNQFYSLEIEGNHLVQSKNRSLIDDKIREMQAFFGLTVTGKLDSNTLEIMKTPRCGVPDVGQYGYTLPGWRKYNLTYRIINYTPDMARAAVDEAIQEGLEVWSKVTPLKFTKISKGIADIMIAFRTRVHGRCPRYFDGPLGVLGHAFPPGPGLGGDTHFDEDENWTKDGAGFNLFLVAAHEFGHALGLSHSNDQTALMFPNYVSLDPRKYPLSQDDINGIQSIYGGLPKVPAKPKEPTIPHACDPDLTFDAITTFRREVMFFKGRHLWRIYYDITDVEFELIASFWPSLPADLQAAYENPRDKILVFKDENFWMIRGYAVLPDYPKSIHTLGFPGRVKKIDAAVCDKTTRKTYFFVGIWCWRFDEMTQTMDKGFPQRVVKHFPGISIRVDAAFQYKGFFFFSRGSKQFEYNIKTKNITRIMRTNTWFQCKEPKNSSFGFDINKEKAHSGGIK

SEQ ID NO: 179 - protein, 18 aa, Homo sapiens
ILYHKSLSLFIFGIVHLL

SEQ ID NO: 180 - protein, 7 aa, Homo sapiens
KNTSIYQ

SEQ ID NO: 181 - DNA, 2467 bp, Mus sp.
gctttaactgaagagacaggaatgaagtgccttctgtctctgatggttaattttataacactttccgctgcatttcctccagacaggaaggacaaaaatgaggagaacaaccaactggcccaggcatatctcaaccagttctactctcttgaaatagaagggagtcattttgtccaaagcaagaacaggagtctctttgatggaaaacttcgggaaatgcaggcatttttcggattgacagtgactggaaaactggattcagacacacttgcgatcatgaaagtgcccaggtgtggggtaccagatgtggggcaatatggctacacactccctgggtggagaaaatacagccttacatacagaataatgaactatactcctgatatgacaccagctgatgtggatgaggctattcagaaagctctacaagtttggagcaaggtcactccactgacgtttaccaggatatccaagggggttgcagatataatgatagcattcaggacaggagtccatggctggtgtcctcgtcactttgatggtcctctgggagtccttggccatgcctttcctcctggtctgggtctaggtggtgacactcactttgacgaagatgaaacatggatagccaaggatggggaagggttcaacttgtttcttgtggctgctcatgaatttggtcactctctggggctgtcccactccaatgatcaaacagccttgatgttccccaattacatctccctggatcctagcaaatacccactttctcaggatgatattgatgggatccagtccatctatggaagtccacctaaggtaaccaccaagccaagtggaaattctgaaccccacgcctgtgaccccaccttgacttttgatgctatcactactttccgcagggaagttatgttctttaaaggcaggtaaacctattcccttgacactccagcttcttataaagatgtttttttttttcaaaggatctccggataaacagtcttctactcagctagaaagccagttgctgagcatgtaccagtacatcagcaagagattcttcctcaagaaacaatgtagaaaacaatcaaagaaaacacccaagggcaacctgcagcctccacacataagcacacatgcattcacatgtatgccccacatatgtgaacatgtaggcacacatgcatgcataccacaaaccacaaacttaagactgaaacatgctgatggacacaggtaccaggacatcattgatgaaatattttgtgtttaatgcaggcacttatggagggtctactctgatattgctggtgctgagtttgagtttattgattccttctggccatctctgccagctgatcttcaagctgcctatgaaagccccagagatgagctccttgtttttaaagatgagaatttctgggtcatcaggggatattctgtcttgcccggttaccccaaatccatccacacactcggatttccaagacgtgtgaagaaaattgatgcagccgtctgtgatcatgatacaagaaaaaccttcttttttgttggcatctggtgctggaggtatgatgagatggcacaagcaatggacagaggattcccacagaggataataaagtgcttcccaggaattcgcctccgtgtggatgctgtcttccaacataatggattcctctatttcttccatgggtcgaggcaatttgaatatgacatgaaggcgaaaaatatcacccaagtgatcaaaaccaattcttggttcctgtgtaacgaaccattaaacgcatcattcaatgtcagtgtcaaaggaaaagcaaattcaattggcacagtgatattacatcataaaaggttaagcttgctcactttcagtattgttcatgtgctgacaaaaacatacaattaacaataaattccacaaataaaccaaaacaaatcttttaacctgaactctgcctcaggaagactcaagagtgggagagatgacccagtggttaagtgcactggctgctctttcaaaggacccaggtttgattctcagtacccacatggcagtccacagctctctgtaactccagacccagggaaatctgatgccctctctggcctctgagggcactgcacaagcatggtgcatagacatatacatgcaagcaaacggctatatatttaaaataaaatgaaaaagtaaaataattgagcccaattctttagcatcaagttcttactcctactatatatcagctgggtaaccaataaccagttaaagtatctgattcttctaacagtgaagttttaaatatgacaaaaatctctcacttattttgagtctaattaatgatttgcaaacttggaaaattaaagcatgtcttaaaaataaacattaaagacaattcttaatccaaaaaaaaaaaaaaaaaaaaaaaaaaaaaaaaaaaaaaaaaaaaaaaaaaaaaaaaaaaaa

SEQ ID NO: 182 - DNA, 1554 bp, Mus sp.
gctttaactgaagagacaggaatgaagtgccttctgtctctgatggttaattttataacactttccgctgcatttcctccagacaggaaggacaaaaatgaggagaacaaccaactggcccaggcatatctcaaccagttctactctcttgaaatagaagggagtcattttgtccaaagcaagaacaggagtctctttgatggaaaacttcgggaaatgcaggcatttttcggattgacagtgactggaaaactggattcagacacacttgcgatcatgaaagtgcccaggtgtggggtaccagatgtggggcaatatggctacacactccctgggtggagaaaatacagccttacatacagaataatgaactatactcctgatatgacaccagctgatgtggatgaggctattcagaaagctctacaagtttggagcaaggtcactccactgacgtttaccaggatatccaagggggttgcagatataatgatagcattcaggacaggagtccatggctggtgtcctcgtcactttgatggtcctctgggagtccttggccatgcctttcctcctggtctgggtctaggtggtgacactcactttgacgaagatgaaacatggatagccaaggatggggaagggttcaacttgtttcttgtggctgctcatgaatttggtcactctctggggctgtcccactccaatgatcaaacagccttgatgttccccaattacatctccctggatcctagcaaatacccactttctcaggatgatattgatgggatccagtccatctatggaagtccacctaaggtaaccaccaagccaagtggaaattctgaaccccacgcctgtgaccccaccttgacttttgatgctatcactactttccgcagggaagttatgttctttaaaggcaggcacttatggagggtctactctgatattgctggtgctgagtttgagtttattgattccttctggccatctctgccagctgatcttcaagctgcctatgaaagccccagagatgagctccttgtttttaaagatgagaatttctgggtcatcaggggatattctgtcttgcccggttaccccaaatccatccacacactcggatttccaagacgtgtgaagaaaattgatgcagccgtctgtgatcatgatacaagaaaaaccttcttttttgttggcatctggtgctggaggtatgatgagatggcacaagcaatggacagaggattcccacagaggataataaagtgcttcccaggaattcgcctccgtgtggatgctgtcttccaacataatggattcctctatttcttccatgggtcgaggcaatttgaatatgacatgaaggcgaaaaatatcacccaagtgatcaaaaccaattcttggttcctgtgtaacgaaccattaaacgcatcattcaatgtcagtgtcaaaggaaaagcaaattcaattggcacagtgatattacatcataaaaggttaagcttgctcactttcagtattgttcatgtgctgacaaaaacatacaat

SEQ ID NO: 183 - protein, 511 aa, Mus sp.
MKCLLSLMVNFITLSAAFPPDRKDKNEENNQLAQAYLNQFYSLEIEGSHFVQSKNRSLFDGKLREMQAFFGLTVTGKLDSDTLAIMKVPRCGVPDVGQYGYTLPGWRKYSLTYRIMNYTPDMTPADVDEAIQKALQVWSKVTPLTFTRISKGVADIMIAFRTGVHGWCPRHFDGPLGVLGHAFPPGLGLGGDTHFDEDETWIAKDGEGFNLFLVAAHEFGHSLGLSHSNDQTALMFPNYISLDPSKYPLSQDDIDGIQSIYGSPPKVTTKPSGNSEPHACDPTLTFDAITTFRREVMFFKGRHLWRVYSDIAGAEFEFIDSFWPSLPADLQAAYESPRDELLVFKDENFWVIRGYSVLPGYPKSIHTLGFPRRVKKIDAAVCDHDTRKTFFFVGIWCWRYDEMAQAMDRGFPQRIIKCFPGIRLRVDAVFQHNGFLYFFHGSRQFEYDMKAKNITQVIKTNSWFLCNEPLNASFNVSVKGKANSIGTVILHHKRLSLLTFSIVHVLTKTYN

SEQ ID NO: 184 - protein, 17 aa, Mus sp.
MKCLLSLMVNFITLSAA

SEQ ID NO: 185 - protein, 494 aa, Mus sp.
FPPDRKDKNEENNQLAQAYLNQFYSLEIEGSHFVQSKNRSLFDGKLREMQAFFGLTVTGKLDSDTLAIMKVPRCGVPDVGQYGYTLPGWRKYSLTYRIMNYTPDMTPADVDEAIQKALQVWSKVTPLTFTRISKGVADIMIAFRTGVHGWCPRHFDGPLGVLGHAFPPGLGLGGDTHFDEDETWIAKDGEGFNLFLVAAHEFGHSLGLSHSNDQTALMFPNYISLDPSKYPLSQDDIDGIQSIYGSPPKVTTKPSGNSEPHACDPTLTFDAITTFRREVMFFKGRHLWRVYSDIAGAEFEFIDSFWPSLPADLQAAYESPRDELLVFKDENFWVIRGYSVLPGYPKSIHTLGFPRRVKKIDAAVCDHDTRKTFFFVGIWCWRYDEMAQAMDRGFPQRIIKCFPGIRLRVDAVFQHNGFLYFFHGSRQFEYDMKAKNITQVIKTNSWFLCNEPLNASFNVSVKGKANSIGTVILHHKRLSLLTFSIVHVLTKTYN

SEQ ID NO: 186 - skipped
  Unknown

SEQ ID NO: 187 - skipped
  Unknown

SEQ ID NO: 188 - skipped
  Unknown

SEQ ID NO: 189 - skipped
  Unknown

SEQ ID NO: 190 - skipped
  Unknown

SEQ ID NO: 191 - DNA, 2628 bp, Homo sapiens
gaaaagcgctggccggagggcccgcggccgggccgccggggtgagcgtgccgaggcggctgtggcgcaggcttccagcccccaccatgccgtggcccctgctgctgctgctggccgtgagtggggcccagacaacccggccatgcttccccgggtgccaatgcgaggtggagaccttcggccttttcgacagcttcagcctgactcgggtggattgtagcggcctgggcccccacatcatgccggtgcccatccctctggacacagcccacttggacctgtcctccaaccggctggagatggtgaatgagtcggtgttggcggggccgggctacacgacgttggctggcctggatctcagccacaacctgctcaccagcatctcacccactgccttctcccgccttcgctacctggagtcgcttgacctcagccacaatggcctgacagccctgccagccgagagcttcaccagctcacccctgagcgacgtgaaccttagccacaaccagctccgggaggtctcagtgtctgccttcacgacgcacagtcagggccgggcactacacgtggacctctcccacaacctcattcaccgcctcgtgccccaccccacgagggccggcctgcctgcgcccaccattcagagcctgaacctggcctggaaccggctccatgccgtgcccaacctccgagacttgcccctgcgctacctgagcctggatgggaaccctctagctgtcattggtccgggtgccttcgcggggctgggaggccttacacacctgtctctggccagcctgcagaggctccctgagctggcgcccagtggcttccgtgagctaccgggcctgcaggtcctggacctgtcgggcaaccccaagcttaactgggcaggagctgaggtgttttcaggcctgagctccctgcaggagctggacctttcgggcaccaacctggtgcccctgcctgaggcgctgctcctccacctcccggcactgcagagcgtcagcgtgggccaggatgtgcggtgccggcgcctggtgcgggagggcacctacccccggaggcctggctccagccccaaggtggccctgcactgcgtagacacccgggaatctgctgccaggggccccaccatcttgtgacaaatggtgtggcccagggccacataacagactgctgtcctgggctgcctcaggtcccgagtaacttatgttcaatgtgccaacaccaggggggagcccgcaggcctatgtggcagcgtcaccacaggagttgtgggcctaggagaggctttggacctgggagccacacctaggagcaaagtctcacccctttgtctacgttgcttccccaaaccatgagcagagggacttcgatgccaaaccagactcgggtcccctcctgcttcccttccccacttatcccccaagtgccttccctcatgcctgggccggcctgacccgcaatgggcagagggtgggtgggaccccctgctgcagggcagagttcaggtccactgggctgagtgtccccttgggcccatggcccagtcactcaggggcgagtttcttttctaacatagccctttctttgccatgaggccatgaggcccgcttcatccttttctatttccctagaaccttaatggtagaaggaattgcaaagaatcaagtccacccttctcatgtgacagatggggaaactgaggccttgagaaggaaaaaggctaatctaagttcctgcgggcagtggcatgactggagcacagcctcctgcctcccagcccggacccaatgcactttcttgtctcctctaataagccccaccctccccgcctgggctccccttgctgcccttgcctgttccccattagcacaggagtagcagcagcaggacaggcaagagcctcacaagtgggactctgggcctctgaccagctgtgcggcatgggctaagtcactctgcccttcggagcctctggaagcttagggcacattggttccagcctagccagtttctcaccctgggttggggtcccccagcatccagactggaaacctacccattttcccctgagcatcctctagatgctgccccaaggagttgctgcagttctggagcctcatctggctgggatctccaaggggcctcctggattcagtccccactggccctgagcacgacagcccttcttaccctcccaggaatgccgtgaaaggagacaaggtctgcccgacccatgtctatgctctacccccagggcagcatctcagcttccgaaccctgggctgtttccttagtcttcattttataaaagttgttgcctttttaacggagtgtcactttcaaccggcctcccctacccctgctggccggggatggagacatgtcatttgtaaaagcagaaaaaggttgcatttgttcacttttgtaatattgtcctgggcctgtgttggggtgttgggggaagctgggcatcagtggccacatgggcatcaggggctggccccacagagaccccacagggcagtgagctctgtcttcccccacctgcctagcccatcatctatctaaccggtccttgatttaataaacactataaaaagttaaaaaaaaaaaaaaa

SEQ ID NO: 192 - DNA, 1059 bp, Homo sapiens
atgccgtggcccctgctgctgctgctggccgtgagtggggcccagacaacccggccatgcttccccgggtgccaatgcgaggtggagaccttcggccttttcgacagcttcagcctgactcgggtggattgtagcggcctgggcccccacatcatgccggtgcccatccctctggacacagcccacttggacctgtcctccaaccggctggagatggtgaatgagtcggtgttggcggggccgggctacacgacgttggctggcctggatctcagccacaacctgctcaccagcatctcacccactgccttctcccgccttcgctacctggagtcgcttgacctcagccacaatggcctgacagccctgccagccgagagcttcaccagctcacccctgagcgacgtgaaccttagccacaaccagctccgggaggtctcagtgtctgccttcacgacgcacagtcagggccgggcactacacgtggacctctcccacaacctcattcaccgcctcgtgccccaccccacgagggccggcctgcctgcgcccaccattcagagcctgaacctggcctggaaccggctccatgccgtgcccaacctccgagacttgcccctgcgctacctgagcctggatgggaaccctctagctgtcattggtccgggtgccttcgcggggctgggaggccttacacacctgtctctggccagcctgcagaggctccctgagctggcgcccagtggcttccgtgagctaccgggcctgcaggtcctggacctgtcgggcaaccccaagcttaactgggcaggagctgaggtgttttcaggcctgagctccctgcaggagctggacctttcgggcaccaacctggtgcccctgcctgaggcgctgctcctccacctcccggcactgcagagcgtcagcgtgggccaggatgtgcggtgccggcgcctggtgcgggagggcacctacccccggaggcctggctccagccccaaggtggccctgcactgcgtagacacccgggaatctgctgccaggggccccaccatcttg

SEQ ID NO: 193 - protein, 353 aa, Homo sapiens
MPWPLLLLLAVSGAQTTRPCFPGCQCEVETFGLFDSFSLTRVDCSGLGPHIMPVPIPLDTAHLDLSSNRLEMVNESVLAGPGYTTLAGLDLSHNLLTSISPTAFSRLRYLESLDLSHNGLTALPAESFTSSPLSDVNLSHNQLREVSVSAFTTHSQGRALHVDLSHNLIHRLVPHPTRAGLPAPTIQSLNLAWNRLHAVPNLRDLPLRYLSLDGNPLAVIGPGAFAGLGGLTHLSLASLQRLPELAPSGFRELPGLQVLDLSGNPKLNWAGAEVFSGLSSLQELDLSGTNLVPLPEALLLHLPALQSVSVGQDVRCRRLVREGTYPRRPGSSPKVALHCVDTRESAARGPTIL

SEQ ID NO: 194 - protein, 16 aa, Homo sapiens
MPWPLLLLLAVSGAQT

SEQ ID NO: 195 - protein, 337 aa, Homo sapiens
TRPCFPGCQCEVETFGLFDSFSLTRVDCSGLGPHIMPVPIPLDTAHLDLSSNRLEMVNESVLAGPGYTTLAGLDLSHNLLTSISPTAFSRLRYLESLDLSHNGLTALPAESFTSSPLSDVNLSHNQLREVSVSAFTTHSQGRALHVDLSHNLIHRLVPHPTRAGLPAPTIQSLNLAWNRLHAVPNLRDLPLRYLSLDGNPLAVIGPGAFAGLGGLTHLSLASLQRLPELAPSGFRELPGLQVLDLSGNPKLNWAGAEVFSGLSSLQELDLSGTNLVPLPEALLLHLPALQSVSVGQDVRCRRLVREGTYPRRPGSSPKVALHCVDTRESAARGPTIL

SEQ ID NO: 196 - protein, 200 aa, Homo sapiens
TRPCFPGCQCEVETFGLFDSFSLTRVDCSGLGPHIMPVPIPLDTAHLDLSSNRLEMVNESVLAGPGYTTLAGLDLSHNLLTSISPTAFSRLRYLESLDLSHNGLTALPAESFTSSPLSDVNLSHNQLREVSVSAFTTHSQGRALHVDLSHNLIHRLVPHPTRAGLPAPTIQSLNLAWNRLHAVPNLRDLPLRYLSLDGNP

SEQ ID NO: 197 - protein, 23 aa, Homo sapiens
LAVIGPGAFAGLGGLTHLSLASL

SEQ ID NO: 198 - protein, 114 aa, Homo sapiens
QRLPELAPSGFRELPGLQVLDLSGNPKLNWAGAEVFSGLSSLQELDLSGTNLVPLPEALLLHLPALQSVSVGQDVRCRRLVREGTYPRRPGSSPKVALHCVDTRESAARGPTIL

SEQ ID NO: 199 - skipped
  Unknown

SEQ ID NO: 200 - skipped
  Unknown

SEQ ID NO: 201 - DNA, 3770 bp, Homo sapiens
gtcgacccacgcgtccgcccggcctagcgccgcgggtcgcgccgagccgagccgagccgagcggagccggcggagcctctggaatcacccgggtcgctgttcctgaggtggtcaaggtggacagggggcggtggtgatggcgcagtttgacactgaataccagcgcctagaggcctcctatagtgattcacccccaggggaggaggacctgttggtgcacgtcgccgaggggagcaagtcaccttggcaccatattgaaaaccttgacctcttcttctctcgagtttataatctgcaccagaagaatggcttcacatgtatgctcatcggggagatctttgagctcatgcagttcctctttgtggttgccttcactaccttcctggtcagctgcgtggactatgacatcctatttgccaacaagatggtgaaccacagtcttcaccctactgaacccgtcaaggtcactctgccagacgcctttttgcctgctcaagtctgtagtgccaggattcaggaaaatggctcccttatcaccatcctggtcattgctggtgtcttctggatccaccggcttatcaagttcatctataacatttgctgctactgggagatccactccttctacctgcacgctctgcgcatccctatgtctgcccttccgtattgcacgtggcaagaagtgcaggcccggatcgtgcagacgcagaaggagcaccagatctgcatccacaaacgtgagctgacagaactggacatctaccaccgcatcctccgtttccagaactacatggtggcactggttaacaaatccctcctgcctctgcgcttccgcctgcctggcctcggggaagctgtcttcttcacccgtggtctcaagtacaactttgagctgatcctcttctggggacctggctctctgtttctcaatgaatggagcctcaaggccgagtacaaacgtggggggcaacggctagagctggcccagcgcctcagcaaccgcatcctgtggattggcatcgctaacttcctgctgtgccccctcatcctcatatggcaaatcctctatgccttcttcagctatgctgaggtgctgaagcgggagccgggggccctgggagcacgctgctggtcactctatggccgctgctacctccgccacttcaacgagctggagcacgagctgcagtcccgcctcaaccgtggctacaagcccgcctccaagtacatgaattgcttcttgtcacctcttttgacactgctggccaagaatggagccttcttcgctggctccatcctggctgtgcttattgccctcaccatttatgacgaagatgtgttggctgtggaacatgtgctgaccaccgtcacactcctgggggtcaccgtgaccgtgtgcaggtcctttatcccggaccagcacatggtgttctgccctgagcagctgctccgcgtgatcctcgctcacatccactacatgcctgaccactggcagggtaatgcccaccgctcgcagacccgggacgagtttgcccagctcttccagtacaaggcagtgttcattttggaagagttgctgagccccattgtcacacccctcatcctcatcttctgcctgcgcccacgggccctggagattatagacttcttccgaaacttcaccgtggaggtcgttggtgtgggagatacctgctcctttgctcagatggatgttcgccagcatggtcatccccagtggctatctgctgggcagacagaggcctcagtgtaccagcaagctgaggatggaaagacagagttgtcactcatgcactttgccatcaccaaccctggctggcagccaccacgtgagagcacagccttcctaggcttcctcaaggagcaggttcagcgggatggagcagctgctagcctcgcccaagggggtctgctccctgaaaatgccctctttacgtctatccagtccttacaatctgagtctgagcccctgagccttatcgcaaatgtggtagctggctcatcctgccggggccctccactgcccagagacctgcagggctccaggcacagggctgaagtcgcctctgccctgcgctccttctccccgctgcaacccgggcaggcgcccacaggccgggctcacagcaccatgacaggctctggggtggatgccaggacagccagctccgggagcagcgtgtgggaaggacagctgcagagcctggtgctgtcagaatatgcatccacagagatgagcctgcatgccctctatatgcaccagctccacaagcagcaggcccaggctgaacctgagcggcatgtatggcaccgccgggagagtgatgagagtggagaaagcgcccctgatgaagggggagagggcgcccgggccccccagtctatccctcgctctgctagctatccctgtgcagcaccccggcctggagctcctgagaccaccgccctgcatgggggcttccagaggcgctacggtggcatcacagatcctggcacagtgcccagggttccctctcatttctctcggctgcctcttggagggtgggcagaagatgggcagtcggcatcaaggcaccctgagcccgtgcccgaagagggctcggaggatgagctaccccctcaggtgcacaaggtatagacaaggctgagcagggttcctgtggcccaggatggaggccaccgctgccctgccatcccgtctgcctgccatgggacggctcctctgagtgttccctggccccacgtgtgtggtgtttgtgtgtctgtgcctggccaagggaggtgccaacactgggcttgccacagccccaggagaggaatttggggcctaggaaccgagggcacacgggactctagcctcatccccaggacccccttggctcagagtgtggtgctagaaactggtccccagcccagccccagtactgccacctttacacctacccctgcaagtccccagagggctgcccacgatagaagctgccaagcagggagaacctgtgccaactgtggagtggggaggttgggcctggaccctcaacccctgcaaccttccctagccccctcaatagatgagcaggtcaggctgtggcccttacctcacccgcagttctcgcccagtgctgcagccggctcacctctctccgcttcttgcacatcactggcctgtgtgtgctgcttgctcctgttctgttcgcttgctcccgttccgttcggcttttgctttgcgttagggtgaagaccctagcgtccagctcccctcaacgctatattttgacactaaaaaagaaggtttctaaattgtaggagcaggatggaaatactttgctgcccttgccatcttttaggatgggcccccaggagactgaggtcttcctgggccctcattgctgcttatcgtaccccccatcacctgcacatgggacagaccgggctggagggtgaccttggctgtgtacgtcccagcaaaagagctctggcccgcatctcgctgtgccctgaagggggatgaagggcgatgcctcgcccgaggctttgggctgctgcactgcatgctgggactgctcctactctctgtcccacccctcacccagctgtggtccggctttgggagagtggtgaattgcgctgcccgaactcggagcggagcagggtagggaccgtgtacagcttgataacccttaataaaaagggagtttgaccagaaaaaaaaaaaaaaaaaaaaaaaaaaaaaaaaaaaaaagggcggccgc

SEQ ID NO: 202 - DNA, 2337 bp, Homo sapiens
tgtatgctcatcggggagatctttgagctcatgcagttcctctttgtggttgccttcactaccttcctggtcagctgcgtggactatgacatcctatttgccaacaagatggtgaaccacagtcttcaccctactgaacccgtcaaggtcactctgccagacgcctttttgcctgctcaagtctgtagtgccaggattcaggaaaatggctcccttatcaccatcctggtcattgctggtgtcttctggatccaccggcttatcaagttcatctataacatttgctgctactgggagatccactccttctacctgcacgctctgcgcatccctatgtctgcccttccgtattgcacgtggcaagaagtgcaggcccggatcgtgcagacgcagaaggagcaccagatctgcatccacaaacgtgagctgacagaactggacatctaccaccgcatcctccgtttccagaactacatggtggcactggttaacaaatccctcctgcctctgcgcttccgcctgcctggcctcggggaagctgtcttcttcacccgtggtctcaagtacaactttgagctgatcctcttctggggacctggctctctgtttctcaatgaatggagcctcaaggccgagtacaaacgtggggggcaacggctagagctggcccagcgcctcagcaaccgcatcctgtggattggcatcgctaacttcctgctgtgccccctcatcctcatatggcaaatcctctatgccttcttcagctatgctgaggtgctgaagcgggagccgggggccctgggagcacgctgctggtcactctatggccgctgctacctccgccacttcaacgagctggagcacgagctgcagtcccgcctcaaccgtggctacaagcccgcctccaagtacatgaattgcttcttgtcacctcttttgacactgctggccaagaatggagccttcttcgctggctccatcctggctgtgcttattgccctcaccatttatgacgaagatgtgttggctgtggaacatgtgctgaccaccgtcacactcctgggggtcaccgtgaccgtgtgcaggtcctttatcccggaccagcacatggtgttctgccctgagcagctgctccgcgtgatcctcgctcacatccactacatgcctgaccactggcagggtaatgcccaccgctcgcagacccgggacgagtttgcccagctcttccagtacaaggcagtgttcattttggaagagttgctgagccccattgtcacacccctcatcctcatcttctgcctgcgcccacgggccctggagattatagacttcttccgaaacttcaccgtggaggtcgttggtgtgggagatacctgctcctttgctcagatggatgttcgccagcatggtcatccccagtggctatctgctgggcagacagaggcctcagtgtaccagcaagctgaggatggaaagacagagttgtcactcatgcactttgccatcaccaaccctggctggcagccaccacgtgagagcacagccttcctaggcttcctcaaggagcaggttcagcgggatggagcagctgctagcctcgcccaagggggtctgctccctgaaaatgccctctttacgtctatccagtccttacaatctgagtctgagcccctgagccttatcgcaaatgtggtagctggctcatcctgccggggccctccactgcccagagacctgcagggctccaggcacagggctgaagtcgcctctgccctgcgctccttctccccgctgcaacccgggcaggcgcccacaggccgggctcacagcaccatgacaggctctggggtggatgccaggacagccagctccgggagcagcgtgtgggaaggacagctgcagagcctggtgctgtcagaatatgcatccacagagatgagcctgcatgccctctatatgcaccagctccacaagcagcaggcccaggctgaacctgagcggcatgtatggcaccgccgggagagtgatgagagtggagaaagcgcccctgatgaagggggagagggcgcccgggccccccagtctatccctcgctctgctagctatccctgtgcagcaccccggcctggagctcctgagaccaccgccctgcatgggggcttccagaggcgctacggtggcatcacagatcctggcacagtgcccagggttccctctcatttctctcggctgcctcttggagggtgggcagaagatgggcagtcggcatcaaggcaccctgagcccgtgcccgaagagggctcggaggatgagctaccccctcaggtgcacaaggta

SEQ ID NO: 203 - protein, 778 aa, Homo sapiens
MLIGEIFELMQFLFVVAFTTFLVSCVDYDILFANKMVNHSLHPTEPVKVTLPDAFLPAQVCSARIQENGSLITILVIAGVFWIHRLIKFIYNICCYWEIHSFYLHALRIPMSALPYCTWQEVQARIVQTQKEHQICIHKRELTELDIYHRILRFQNYMVALVNKSLLPLRFRLPGLGEAVFFTRGLKYNFELILFWGPGSLFLNEWSLKAEYKRGGQRLELAQRLSNRILWIGIANFLLCPLILIWQILYAFFSYAEVLKREPGALGARCWSLYGRCYLRHFNELEHELQSRLNRGYKPASKYMNCFLSPLLTLLAKNGAFFAGSILAVLIALTIYDEDVLAVEHVLTTVTLLGVTVTVCRSFIPDQHMVFCPEQLLRVILAHIHYMPDHWQGNAHRSQTRDEFAQLFQYKAVFILEELLSPIVTPLILIFCLRPRALEIIDFFRNFTVEVVGVGDTCSFAQMDVRQHGHPQWLSAGQTEASVYQQAEDGKTELSLMHFAITNPGWQPPRESTAFLGFLKEQVQRDGAAASLAQGGLLPENALFTSIQSLQSESEPLSLIANVVAGSSCRGPPLPRDLQGSRHRAEVASALRSFSPLQPGQAPTGRAHSTMTGSGVDARTASSGSSVWEGQLQSLVLSEYASTEMSLHALYMHQLHKQQAQAEPERHVWHRRESDESGESAPDEGGEGARAPQSIPRSASYPCAAPRPGAPETTALHGGFQRRYGGITDPGTVPRVPSHFSRLPLGGWAEDGQSASRHPEPVPEEGSEDELPPQVHKV

SEQ ID NO: 204 - protein, 25 aa, Homo sapiens
MLIGEIFELMQFLFVVAFTTFLVSC

SEQ ID NO: 205 - protein, 753 aa, Homo sapiens
VDYDILFANKMVNHSLHPTEPVKVTLPDAFLPAQVCSARIQENGSLITILVIAGVFWIHRLIKFIYNICCYWEIHSFYLHALRIPMSALPYCTWQEVQARIVQTQKEHQICIHKRELTELDIYHRILRFQNYMVALVNKSLLPLRFRLPGLGEAVFFTRGLKYNFELILFWGPGSLFLNEWSLKAEYKRGGQRLELAQRLSNRILWIGIANFLLCPLILIWQILYAFFSYAEVLKREPGALGARCWSLYGRCYLRHFNELEHELQSRLNRGYKPASKYMNCFLSPLLTLLAKNGAFFAGSILAVLIALTIYDEDVLAVEHVLTTVTLLGVTVTVCRSFIPDQHMVFCPEQLLRVILAHIHYMPDHWQGNAHRSQTRDEFAQLFQYKAVFILEELLSPIVTPLILIFCLRPRALEIIDFFRNFTVEVVGVGDTCSFAQMDVRQHGHPQWLSAGQTEASVYQQAEDGKTELSLMHFAITNPGWQPPRESTAFLGFLKEQVQRDGAAASLAQGGLLPENALFTSIQSLQSESEPLSLIANVVAGSSCRGPPLPRDLQGSRHRAEVASALRSFSPLQPGQAPTGRAHSTMTGSGVDARTASSGSSVWEGQLQSLVLSEYASTEMSLHALYMHQLHKQQAQAEPERHVWHRRESDESGESAPDEGGEGARAPQSIPRSASYPCAAPRPGAPETTALHGGFQRRYGGITDPGTVPRVPSHFSRLPLGGWAEDGQSASRHPEPVPEEGSEDELPPQVHKV

SEQ ID NO: 206 - protein, 45 aa, Homo sapiens
VDYDILFANKMVNHSLHPTEPVKVTLPDAFLPAQVCSARIQENGS

SEQ ID NO: 207 - protein, 17 aa, Homo sapiens
LITILVIAGVFWIHRLI

SEQ ID NO: 208 - protein, 141 aa, Homo sapiens
KFIYNICCYWEIHSFYLHALRIPMSALPYCTWQEVQARIVQTQKEHQICIHKRELTELDIYHRILRFQNYMVALVNKSLLPLRFRLPGLGEAVFFTRGLKYNFELILFWGPGSLFLNEWSLKAEYKRGGQRLELAQRLSNR

SEQ ID NO: 209 - protein, 25 aa, Homo sapiens
ILWIGIANFLLCPLILIWQILYAFF

SEQ ID NO: 210 - protein, 66 aa, Homo sapiens
SYAEVLKREPGALGARCWSLYGRCYLRHFNELEHELQSRLNRGYKPASKYMNCFLSPLLTLLAKNG

SEQ ID NO: 211 - protein, 17 aa, Homo sapiens
AFFAGSILAVLIALTIY

SEQ ID NO: 212 - protein, 9 aa, Homo sapiens
DEDVLAVEH

SEQ ID NO: 213 - protein, 19 aa, Homo sapiens
VLTTVTLLGVTVTVCRSFI

SEQ ID NO: 214 - protein, 414 aa, Homo sapiens
PDQHMVFCPEQLLRVILAHIHYMPDHWQGNAHRSQTRDEFAQLFQYKAVFILEELLSPIVTPLILIFCLRPRALEIIDFFRNFTVEVVGVGDTCSFAQMDVRQHGHPQWLSAGQTEASVYQQAEDGKTELSLMHFAITNPGWQPPRESTAFLGFLKEQVQRDGAAASLAQGGLLPENALFTSIQSLQSESEPLSLIANVVAGSSCRGPPLPRDLQGSRHRAEVASALRSFSPLQPGQAPTGRAHSTMTGSGVDARTASSGSSVWEGQLQSLVLSEYASTEMSLHALYMHQLHKQQAQAEPERHVWHRRESDESGESAPDEGGEGARAPQSIPRSASYPCAAPRPGAPETTALHGGFQRRYGGITDPGTVPRVPSHFSRLPLGGWAEDGQSASRHPEPVPEEGSEDELPPQVHKV

SEQ ID NO: 215 - DNA, 2448 bp, Homo sapiens
atggcgcagtttgacactgaataccagcgcctagaggcctcctatagtgattcacccccaggggaggaggacctgttggtgcacgtcgccgaggggagcaagtcaccttggcaccatattgaaaaccttgacctcttcttctctcgagtttataatctgcaccagaagaatggcttcacatgtatgctcatcggggagatctttgagctcatgcagttcctctttgtggttgccttcactaccttcctggtcagctgcgtggactatgacatcctatttgccaacaagatggtgaaccacagtcttcaccctactgaacccgtcaaggtcactctgccagacgcctttttgcctgctcaagtctgtagtgccaggattcaggaaaatggctcccttatcaccatcctggtcattgctggtgtcttctggatccaccggcttatcaagttcatctataacatttgctgctactgggagatccactccttctacctgcacgctctgcgcatccctatgtctgcccttccgtattgcacgtggcaagaagtgcaggcccggatcgtgcagacgcagaaggagcaccagatctgcatccacaaacgtgagctgacagaactggacatctaccaccgcatcctccgtttccagaactacatggtggcactggttaacaaatccctcctgcctctgcgcttccgcctgcctggcctcggggaagctgtcttcttcacccgtggtctcaagtacaactttgagctgatcctcttctggggacctggctctctgtttctcaatgaatggagcctcaaggccgagtacaaacgtggggggcaacggctagagctggcccagcgcctcagcaaccgcatcctgtggattggcatcgctaacttcctgctgtgccccctcatcctcatatggcaaatcctctatgccttcttcagctatgctgaggtgctgaagcgggagccgggggccctgggagcacgctgctggtcactctatggccgctgctacctccgccacttcaacgagctggagcacgagctgcagtcccgcctcaaccgtggctacaagcccgcctccaagtacatgaattgcttcttgtcacctcttttgacactgctggccaagaatggagccttcttcgctggctccatcctggctgtgcttattgccctcaccatttatgacgaagatgtgttggctgtggaacatgtgctgaccaccgtcacactcctgggggtcaccgtgaccgtgtgcaggtcctttatcccggaccagcacatggtgttctgccctgagcagctgctccgcgtgatcctcgctcacatccactacatgcctgaccactggcagggtaatgcccaccgctcgcagacccgggacgagtttgcccagctcttccagtacaaggcagtgttcattttggaagagttgctgagccccattgtcacacccctcatcctcatcttctgcctgcgcccacgggccctggagattatagacttcttccgaaacttcaccgtggaggtcgttggtgtgggagatacctgctcctttgctcagatggatgttcgccagcatggtcatccccagtggctatctgctgggcagacagaggcctcagtgtaccagcaagctgaggatggaaagacagagttgtcactcatgcactttgccatcaccaaccctggctggcagccaccacgtgagagcacagccttcctaggcttcctcaaggagcaggttcagcgggatggagcagctgctagcctcgcccaagggggtctgctccctgaaaatgccctctttacgtctatccagtccttacaatctgagtctgagcccctgagccttatcgcaaatgtggtagctggctcatcctgccggggccctccactgcccagagacctgcagggctccaggcgggctcacagcaccatgacaggctctggggtggatgccaggacagccagctccgggagcagcgtgtgggaaggacagctgcagagcctggtgctgtcagaatatgcatccacagagatgagcctgcatgccctctatatgcaccagctccacaagcagcaggcccaggctgaacctgagcggcatgtatggcaccgccgggagagtgatgagagtggagaaagcgcccctgatgaagggggagagggcgcccgggccccccagtctatccctcgctctgctagctatccctgtgcagcaccccggcctggagctcctgagaccaccgccctgcatgggggcttccagaggcgctacggtggcatcacagatcctggcacagtgcccagggttccctctcatttctctcggctgcctcttggagggtgggcagaagatgggcagtcggcatcaaggcaccctgagcccgtgcccgaagagggctcggaggatgagctaccccctcaggtgcacaaggta

SEQ ID NO: 216 - protein, 816 aa, Homo sapiens
MAQFDTEYQRLEASYSDSPPGEEDLLVHVAEGSKSPWHHIENLDLFFSRVYNLHQKNGFTCMLIGEIFELMQFLFVVAFTTFLVSCVDYDILFANKMVNHSLHPTEPVKVTLPDAFLPAQVCSARIQENGSLITILVIAGVFWIHRLIKFIYNICCYWEIHSFYLHALRIPMSALPYCTWQEVQARIVQTQKEHQICIHKRELTELDIYHRILRFQNYMVALVNKSLLPLRFRLPGLGEAVFFTRGLKYNFELILFWGPGSLFLNEWSLKAEYKRGGQRLELAQRLSNRILWIGIANFLLCPLILIWQILYAFFSYAEVLKREPGALGARCWSLYGRCYLRHFNELEHELQSRLNRGYKPASKYMNCFLSPLLTLLAKNGAFFAGSILAVLIALTIYDEDVLAVEHVLTTVTLLGVTVTVCRSFIPDQHMVFCPEQLLRVILAHIHYMPDHWQGNAHRSQTRDEFAQLFQYKAVFILEELLSPIVTPLILIFCLRPRALEIIDFFRNFTVEVVGVGDTCSFAQMDVRQHGHPQWLSAGQTEASVYQQAEDGKTELSLMHFAITNPGWQPPRESTAFLGFLKEQVQRDGAAASLAQGGLLPENALFTSIQSLQSESEPLSLIANVVAGSSCRGPPLPRDLQGSRRAHSTMTGSGVDARTASSGSSVWEGQLQSLVLSEYASTEMSLHALYMHQLHKQQAQAEPERHVWHRRESDESGESAPDEGGEGARAPQSIPRSASYPCAAPRPGAPETTALHGGFQRRYGGITDPGTVPRVPSHFSRLPLGGWAEDGQSASRHPEPVPEEGSEDELPPQVHKV

SEQ ID NO: 217 - skipped
  Unknown

SEQ ID NO: 218 - skipped
  Unknown

SEQ ID NO: 219 - skipped
  Unknown

SEQ ID NO: 220 - skipped
  Unknown

SEQ ID NO: 221 - DNA, 2989 bp, Homo sapiens
gctgggagcggaggcgcaggcaatgctcagccctggatgtagctgagaggctgggagaagagacgaccgctggagaccgagcggcgtggggaagacctaggggggtgggtgggggaagcagacaggagaacactcgaaatcaagcgctttacagattattttattttgtatagagaacacgtagcgactccgaagatcagccccaatgaacatgtcagtgttgactttacaagaatatgaattcgaaaagcagttcaacgagaatgaagccatccaatggatgcaggaaaactggaagaaatctttcctgttttctgctctgtatgctgcctttatattcggtggtcggcacctaatgaataaacgagcaaagtttgaactgaggaagccattagtgctctggtctctgacccttgcagtcttcagtatattcggtgctcttcgaactggtgcttatatggtgtacattttgatgaccaaaggcctgaagcagtcagtttgtgaccagggtttttacaatggacctgtcagcaaattctgggcttatgcatttgtgctaagcaaagcacccgaactaggagatacaatattcattattctgaggaagcagaagctgatcttcctgcactggtatcaccacatcactgtgctcctgtactcttggtactcctacaaagacatggttgccgggggaggttggttcatgactatgaactatggcgtgcacgccgtgatgtactcttactatgccttgcgggcggcaggtttccgagtctcccggaagtttgccatgttcatcaccttgtcccagatcactcagatgctgatgggctgtgtggttaactacctggtcttctgctggatgcagcatgaccagtgtcactctcactttcagaacatcttctggtcctcactcatgtacctcagctaccttgtgctcttctgccatttcttctttgaggcctacatcggcaaaatgaggaaaacaacgaaagctgaatagtgttggaactgaggaggaagccatagctcagggtcatcaagaaaaataatagacaaaagaaaatggcacaaggaatcacacgtggtgcagctaaaacaaaacaaaacatgagcaaacacaaaacccaaggcagcttagggataattaggttgatttaacccagtaagtttatgatccttttagggtgaggactcactgagtgcacctccatctccaagcactgctgctggaagaccccattccctctttatctatcaactctaggacaagggagaacaaaagcaagccagaagcagaggagactaatcaaaggcaaacaaaggctattaacacataggaaaaaatgtatttactaagtgtcacatttctctaagatgaaagatttttactctagaaactgtgcgagcacaacacacacaatcctttctaactttatggacactaaactggagccaatagaaaagacaaaaatgaaagagacacagggtgtatatctagaacgataatgcttttgcagaaactaaagcctttttaagaaatgccagctgctgtagaccccatgagaaaagatgtcttaatcatccttatgaaaacagatgtaaacaactatatttcaactaacttcatcttcactgcatagcctcaggctagtgagtttgccaaaaccaaagggggtgaatacttccccaagattcttcctgggaggatggaaacagtgcagcccaggtcccatgggggcagctccatcccagagcatttctgatagttgaactgtaatttctactcttaagtgagatatgaagcattatccttttgttcagttgccccgggcttttgaacagaagagtaaatacagaattgaaaaagataaacactcaaccaaacaatgtgaaaacgggttctgtagtatttgtaaaaaggcccggcccaggaccactgtgagctggaaaagggagaaaggcagtgggaaaagaggtgagccgaagatcaattcgacagacagacggtgtgtatgcccctccctgtttgacttcacacacactcataactttccaaatgaaaccccacagtatagcgcatattttcgatatttttgtgaattccaaaaggaaatcacagggctgttcgaaatattgggggaacactgtgtttctgcatcatctgcatttgctccccaagcaatgtagaggtgtttaaagggccctctgctggctgagtggcaatactacaacaaacttcaaggcaagtttggctgaaaacagttgacaacaaagggcccccatacacttatccctcaaattttaagtgatatgaaatacttgtcatgtctttggccaaatcagaagatattcatcctgcttcaagtcagcttcagaaatgttttaaaagggactttagctctggaactcaaaatcaatttattaagagccatattctttaaaaaaaaaaagctggataatattctctgtaatatttcagtcctttacaagccaaatacatgtgtcaatgtttctagtatttcaaagaagcaattatgtaaagttgttcaatgtgacataatagtattataattggttaagtagcttaatgattaggcaaactagatgaaaagattaggggcttccacactgcatagattacacgcacatagccacgcatacacacacagacacacagatgtggggtacactgaacttcaaagcccaaatgaatagaaacacattttctggctagcagaaaaaaacaaaacaaaactgttgtttctctttcttgctttgagagtgtacagtaaaagggattttttcgaattatttttatattattttagctttaattgtgctgtcgttcatgaaacagagctgctctgcttttctgtcagagatggcaagggctttttcagcatctcgtttatgtgtggaatttaaaaagaataaagttttattccattctgtgtgaaaaaaaaaaaaaaaaaaaaaaaaaaaaaaa

SEQ ID NO: 222 - DNA, 795 bp, Homo sapiens
atgaacatgtcagtgttgactttacaagaatatgaattcgaaaagcagttcaacgagaatgaagccatccaatggatgcaggaaaactggaagaaatctttcctgttttctgctctgtatgctgcctttatattcggtggtcggcacctaatgaataaacgagcaaagtttgaactgaggaagccattagtgctctggtctctgacccttgcagtcttcagtatattcggtgctcttcgaactggtgcttatatggtgtacattttgatgaccaaaggcctgaagcagtcagtttgtgaccagggtttttacaatggacctgtcagcaaattctgggcttatgcatttgtgctaagcaaagcacccgaactaggagatacaatattcattattctgaggaagcagaagctgatcttcctgcactggtatcaccacatcactgtgctcctgtactcttggtactcctacaaagacatggttgccgggggaggttggttcatgactatgaactatggcgtgcacgccgtgatgtactcttactatgccttgcgggcggcaggtttccgagtctcccggaagtttgccatgttcatcaccttgtcccagatcactcagatgctgatgggctgtgtggttaactacctggtcttctgctggatgcagcatgaccagtgtcactctcactttcagaacatcttctggtcctcactcatgtacctcagctaccttgtgctcttctgccatttcttctttgaggcctacatcggcaaaatgaggaaaacaacgaaagctgaa

SEQ ID NO: 223 - protein, 265 aa, Homo sapiens
MNMSVLTLQEYEFEKQFNENEAIQWMQENWKKSFLFSALYAAFIFGGRHLMNKRAKFELRKPLVLWSLTLAVFSIFGALRTGAYMVYILMTKGLKQSVCDQGFYNGPVSKFWAYAFVLSKAPELGDTIFIILRKQKLIFLHWYHHITVLLYSWYSYKDMVAGGGWFMTMNYGVHAVMYSYYALRAAGFRVSRKFAMFITLSQITQMLMGCVVNYLVFCWMQHDQCHSHFQNIFWSSLMYLSYLVLFCHFFFEAYIGKMRKTTKAE

SEQ ID NO: 224 - protein, 46 aa, Homo sapiens
MNMSVLTLQEYEFEKQFNENEAIQWMQENWKKSFLFSALYAAFIFG

SEQ ID NO: 225 - protein, 219 aa, Homo sapiens
GRHLMNKRAKFELRKPLVLWSLTLAVFSIFGALRTGAYMVYILMTKGLKQSVCDQGFYNGPVSKFWAYAFVLSKAPELGDTIFIILRKQKLIFLHWYHHITVLLYSWYSYKDMVAGGGWFMTMNYGVHAVMYSYYALRAAGFRVSRKFAMFITLSQITQMLMGCVVNYLVFCWMQHDQCHSHFQNIFWSSLMYLSYLVLFCHFFFEAYIGKMRKTTKAE

SEQ ID NO: 226 - protein, 16 aa, Homo sapiens
GRHLMNKRAKFELRKP

SEQ ID NO: 227 - protein, 17 aa, Homo sapiens
LVLWSLTLAVFSIFGAL

SEQ ID NO: 228 - protein, 57 aa, Homo sapiens
RTGAYMVYILMTKGLKQSVCDQGFYNGPVSKFWAYAFVLSKAPELGDTIFIILRKQK

SEQ ID NO: 229 - protein, 17 aa, Homo Sapiens
LIFLHWYHHITVLLYSW

SEQ ID NO: 230 - protein, 11 aa, Homo sapiens
YSYKDMVAGGG

SEQ ID NO: 231 - protein, 19 aa, Homo sapiens
WFMTMNYGVHAVMYSYYAL

SEQ ID NO: 232 - protein, 10 aa, Homo sapiens
RAAGFRVSRK

SEQ ID NO: 233 - protein, 24 aa, Homo sapiens
FAMFITLSQITQMLMGCVVNYLVF

SEQ ID NO: 234 - protein, 14 aa, Homo sapiens
CWMQHDQCHSHFQN

SEQ ID NO: 235 - protein, 20 aa, Homo sapiens
IFWSSLMYLSYLVLFCHFFF

SEQ ID NO: 236 - protein, 14 aa, Homo sapiens
EAYIGKMRKTTKAE

SEQ ID NO: 237 - skipped
  Unknown

SEQ ID NO: 238 - DNA, 813 bp, Homo sapiens
atggacacatccatgaatttctcacgcgggttaaaaatggacctgatgcaaccctatgacttcgagacgtttcaggacttaaggccctttttggaggagtactgggtaagctcatttctcatagtggtcgtctatctgttgctcatcgttgttggccagacctacatgagaacgcggaagagcttcagcttgcagaggcctctcatcctctggtccttcttcctggcaatattcagtatcctgggtactctgaggatgtggaagtttatggcaacagtgatgtttacagtgggcctcaagcaaaccgtgtgctttgccatctacacggatgacgccgtagtcagattctggtcctttctctttcttctcagcaaggttgttgaactgggagacacggccttcatcatcctgcgtaagcgtccactcatctttgtccactggtaccaccacagcacagtgctactgttcacaagctttggatacaagaacaaagtgccttcgggtggctggttcatgaccatgaactttggcgtccattctgtcatgtacacttactacactatgaaggctgccaaactgaagcatcctaatcttctccccatggtcatcaccagcctgcagattctgcagatggttctgggcaccatctttggcatactgaattacatctggaggcaggagaaaggatgccacacaacaacggaacacttcttctggtcttttatgctatatgggacctatttcatcctattcgctcacttcttccaccgagcctacctcaggcccaagggcaaagttgcatccaagagccaa

SEQ ID NO: 239 - protein, 265 aa, Mus sp.; identical to SEQ ID NO: 223

SEQ ID NO: 240 - skipped
  Unknown

SEQ ID NO: 241 - DNA, 2032 bp, Mus sp.
gcctgaagcagtcagtttgtgaccagagtttttacaatggacctgtcagcaaattctgggcttatgcatttgtgctcagcaaagcacccgaactaggtgacacgatattcatcattctgaggaaacagaaactgatcttcctgcactggtaccaccacatcactgtgctcctgtactcctggtactcctacaaagacatggtcgctgggggtggttggttcatgactatgaactatggcgtgcatgccgtcatgtactcttactacgccttgcgggctgcgggtttccgagtctcccggaagtttgccatgttcatcaccttgtcccagatcactcagatgctgatgggctgtgtcattaactacctggtcttcaactggatgcagcatgacaacgaccagtgctactcccactttcagaacatcttctggtcctcgctcatgtacctcagctaccttgtgctcttctgccatttcttctttgaggcctacatcggcaaagtgaagaaagccacgaaggctgagtagtgtcagggctgaggaggaagtcatagctcagggtcatcacgaaaaataatcgacaaaagaaaaatggcacaaggaatcccatatggtgcagctaaaacaaaacaaaacatccgtatgagcaggcacgaggcccaaggcagcttgggactgaagattaggttgtaagtttatgatcctttctgggtgaggactcgctgagtgcaactcttatctcaaagcacggctgctgaggggaccccttccctctggcctgtcaactctagaacacactagatgcaaaggcagccacgggcaaagagattgggcagagattagtggacggccagcaaaacactgcaggaagcaggtggggggaggaatctactcagcctttttgttttgttttgttttgttttgtttttctctaaggataaaggagtttccccttttcaaacgatgtgagcacacacacacacacacacacacacacacacacacacacacacacgcaatcttttcaacacgaaaccagagctaaaagaaaagataaacatgggagagacagggtttctatctgggacagcaatgcttttgcaaaaggctaggccttttaaagaaaggtgagcttgtaactccttgataaaagatgtcttaattatttttactgcaactgaaagtaaagaggtagagcctttccccttctgcacagcctcagggcttgtatgttctctacaaccaaacacaggacagtacttcccccatgatactttattactgggagaaagaaacccctgtagttgaaacaccacactgacaactgttatttctgctctccgacgagaattcaagcatccgttgttcagttgccccaaactttaggacggaggagtaaatgcagaactgaaagggaagaagctcagctggctggcttgaaaatggagtcttgtaccatgtgtaacaaatgccagcccatcgtccctggagctgaacagggaggaagggctatgggcagagactagagccggattcatccaatgtgcagacagcgtgttcgcctccctccctgttcgacctcacacataatcctggctttctaaatgaggccctgtgacacactctgtgctttctatatttttgtgactttcaaacacagatctgcagggctctgcctgatttggggtaaacactgtgtttctgcagcctctgcatttgctcccttcagcagtgcagaggcttgagaagtgccctctgctggcttagtgagaagcttcaacaaacacttcacagtaggttgaaataactgaccactaagggcctgcggagattaaaccctaagttctaagtgctgtcaaacacctgacatatatttgaccaaatcagaagagagagagaacctctatgcttcaagtaagcgtcataaattttttaagtgactttcacttgagaactcagaaagtcaatgtattaagagccatattctgaaagaaagaaagagaaagaaagaaagaaagaaaaaaaaaaaaaaa

SEQ ID NO: 242 - DNA, 522 bp, Mus sp.
ctgaagcagtcagtttgtgaccagagtttttacaatggacctgtcagcaaattctgggcttatgcatttgtgctcagcaaagcacccgaactaggtgacacgatattcatcattctgaggaaacagaaactgatcttcctgcactggtaccaccacatcactgtgctcctgtactcctggtactcctacaaagacatggtcgctgggggtggttggttcatgactatgaactatggcgtgcatgccgtcatgtactcttactacgccttgcgggctgcgggtttccgagtctcccggaagtttgccatgttcatcaccttgtcccagatcactcagatgctgatgggctgtgtcattaactacctggtcttcaactggatgcagcatgacaacgaccagtgctactcccactttcagaacatcttctggtcctcgctcatgtacctcagctaccttgtgctcttctgccatttcttctttgaggcctacatcggcaaagtgaagaaagccacgaaggctgag

SEQ ID NO: 243 - protein, 174 aa, Mus sp.
LKQSVCDQSFYNGPVSKFWAYAFVLSKAPELGDTIFIILRKQKLIFLHWYHHITVLLYSWYSYKDMVAGGGWFMTMNYGVHAVMYSYYALRAAGFRVSRKFAMFITLSQITQMLMGCVINYLVFNWMQHDNDQCYSHFQNIFWSSLMYLSYLVLFCHFFFEAYIGKVKKATKAE

SEQ ID NO: 244 - protein, 49 aa, Mus sp.
LKQSVCDQSFYNGPVSKFWAYAFVLSKAPELGDTIFIILRKQKLIFLHW

SEQ ID NO: 245 - protein, 17 aa, Mus sp.
YHHITVLLYSWYSYKDM

SEQ ID NO: 246 - protein, 11 aa, Mus sp.
VAGGGWFMTMN

SEQ ID NO: 247 - protein, 19 aa, Mus sp.
YGVHAVMYSYYALRAAGFR

SEQ ID NO: 248 - protein, 10 aa, Mus sp.
VSRKFAMFIT

SEQ ID NO: 249 - protein, 24 aa, Mus sp.
LSQITQMLMGCVINYLVFNWMQHD

SEQ ID NO: 250 - protein, 16 aa, Mus sp.
NDQCYSHFQNIFWSSL

SEQ ID NO: 251 - DNA, 974 bp, Rattus sp.
ctaggtgatacgatattcatcattctgaggaagcagaagctgatcttcctgcactggtaccaccacatcactgtgctcctgtactcttggtactcctacaaagacatggtagctgggggtggttggttcatgactatgaactatggcgtacacgccgtcatgtactcttactacgccttgcgggctgcgggtttccgggtctcccggaagtttgccatgttcatcacgttgtcccagatcactcagatgctgatgggctgtgtcattaactacctggtcttcaactggatgcagcatgacaatgaccagtgctactcccactttcagaacatcttctggtcctcactcatgtacctcagctaccttctgctcttctgccatttcttctttgaggcctacatcggcaaagtgaagaaagcgacgaaggccgagtagtgtcagagctgaggaggaagacatagctcagggtcatcacgaaaaataatagacaaaaagaaaatggcacaaggaatcacatatggtgcagctaaaacaaaacaaaacattatgagcagacgctaagcccaaggcagcttgggagtgaagattaggttgtaagtttatgatcctttttgggtgaggactcactgagaacactgctgctgagggacccccttccctcttacctgtcaactctagaacacactagaagccaaggcagccatgggcaaggagattagtggacagcaagcaaaacactgcaggaagaggggggagatctattcagagttttttgttttgttttgttttgtttttctctaaggataaaggagtttccccttttcaaactgtgtgagcacacccacgcgcatgcagacacacccacctacacactatctgcagatgaccagtgtcctatgctgtttttacaaataaacttgagacaagaaaaaaaaaaaaaaaaaaaaaaaaaaaaaaaaaaaaaaaaaaaaaaa

SEQ ID NO: 252 - DNA, 432 bp, Rattus sp.
ctaggtgatacgatattcatcattctgaggaagcagaagctgatcttcctgcactggtaccaccacatcactgtgctcctgtactcttggtactcctacaaagacatggtagctgggggtggttggttcatgactatgaactatggcgtacacgccgtcatgtactcttactacgccttgcgggctgcgggtttccgggtctcccggaagtttgccatgttcatcacgttgtcccagatcactcagatgctgatgggctgtgtcattaactacctggtcttcaactggatgcagcatgacaatgaccagtgctactcccactttcagaacatcttctggtcctcactcatgtacctcagctaccttctgctcttctgccatttcttctttgaggcctacatcggcaaagtgaagaaagcgacgaaggccgag

SEQ ID NO: 253 - protein, 144 aa, Rattus sp.
LGDTIFIILRKQKLIFLHWYHHITVLLYSWYSYKDMVAGGGWFMTMNYGVHAVMYSYYALRAAGFRVSRKFAMFITLSQITQMLMGCVINYLVFNWMQHDNDQCYSHFQNIFWSSLMYLSYLLLFCHFFFEAYIGKVKKATKAE

SEQ ID NO: 254 - skipped
  Unknown

SEQ ID NO: 255 - skipped
  Unknown

SEQ ID NO: 256 - skipped
  Unknown

SEQ ID NO: 257 - skipped
  Unknown

SEQ ID NO: 258 - skipped
  Unknown

SEQ ID NO: 259 - skipped
  Unknown

SEQ ID NO: 260 - skipped
  Unknown

SEQ ID NO: 261 - skipped
  Unknown

SEQ ID NO: 262 - skipped
  Unknown

SEQ ID NO: 263 - skipped
  Unknown

SEQ ID NO: 264 - skipped
  Unknown

SEQ ID NO: 265 - skipped
  Unknown

SEQ ID NO: 266 - skipped
  Unknown

SEQ ID NO: 267 - skipped
  Unknown

SEQ ID NO: 268 - skipped
  Unknown

SEQ ID NO: 269 - skipped
  Unknown

SEQ ID NO: 270 - skipped
  Unknown

SEQ ID NO: 271 - DNA, 2895 bp, Homo sapiens
gtcgacccacgcgtccggggagcgcggctaagagtgccgcaccgcctcacaacctgggaaccggagagtaggggccgtcggctggcaagaacccgccgtgcctcctcggcaagggccatccggtgccacccatgtcgcactagagcagaagagggtgagtcctgaactgcaacctgcacagagctgctctgtactgtccctggtggtcgccgccatgacctggttggtgctgctggggacactgctctgcatgctgcgcgttgggttaggcaccccggactccgagggtttcccgccccgtgcgctccacaactgcccctacaaatgtatctgcgctgccgacctgctaagctgcactggcctagggctgcaggacgtgccagccgagttacctgccgctactgcggacctcgacctgagccacaacgcgctccagcgcctgcgccccggctggttggcgcccctcttccagctgcgcgccctgcacctagaccacaacgaactagatgcgctgggtcgcggcgtcttcgtcaacgccagcggcctgaggctgctcgatctatcatctaacacgttgcgggcgcttggccgccacgacctcgacgggctgggggcgctggagaagctgcttctgttcaataaccgcttggtgcacttggacgagcatgccttccacggcctgcgcgcgctcagccatctctacctgggctgcaacgaactcgcctcgttctccttcgaccacctgcacggtctgagcgccacccacctgcttactctggacctctcctccaaccggctgggacacatctccgtacctgagctggccgcgctgccggccttcctcaagaacggcctctacttgcacaacaaccctttgccttgcgactgccgcctctaccacctgctacagcgctggcaccagcggggcctgagcgccgtgcgcgactttgcgcgcgagtacgtatgcttggccttcaaggtacccgcgtcccgcgtgcgcttcttccagcacagccgcgtctttgagaactgctcgtcggccccagctcttggcctaaagcggccggaagagcacctgtacgcgctggtgggtcggtccctgaggctttactgcaacaccagcgtcccggccatgcgcattgcctgggtttcgccgcagcaggagcttctcagggcgccaggatcccgcgatggcagcatcgcggtgctggccgacggcagcttggccataggcaacgtacaggagcagcatgcgggactcttcgtgtgcctggccactgggccccgcctgcaccacaaccagacgcacgagtacaacgtgagcgtgcactttccgcgcccagagcccgaggctttcaacacaggcttcaccacactgctgggctgtgccgtgggccttgtgctcgtgctgctctacctgttcgccccaccctgccgctgctgccgccgtgcctgcccgctgccgccgctggccccaaacacccagcccgctccaagagctgagccgcacaagtcctcagtactcagcaccacaccgccagacgcacccagcccgcaaggccaagcgtccacaagcacgtagtctttctggagccaggccggaggggcctcaatggcccgcgtgcagctggcagtagctgaggaattcgatctctacaaccctggaggcctgcagctgaaggctggctctgagtccgccagctccataggctccgagggtcccatgacaacctagactgccagggctcccccacccaggcccccaccctcttgctgctcgccctgctccctgcttcggtccagagaactggcagatactggtgggaagcactgtgcctggccccccagcttcctgtatgggcctcgaaacacaatgggccttctcgctcactggtagagacaggggttgtggtccccaacctgccttctgctctgcccctgcacaggacccaaaggccccaggccctgcaaggtgtgctagttcctgctttcccgcggacttcctagtgcccaaatgccctgtgaggctgagagacccaggcccctgtggctttcaacacagcacagctgtggaagtggctgtgttcttctacagcctgtggaagaacccctgtagcagagcctcccatccaccctcaggggctgaggcagctctcgaggagtggtgctcaagagctgacgcagggccacctccccttcccaagggggtgggagggagtgggcccacagggaaaagaaggcggctctgaaggaagatctcgcccacaccccaggacagaaagaggaaacaagcccgccctctggtgaaatgggactccctccatccaccaacacccaacctcctgaaagcttcacaacttcacgcagagtccggtggcaggcaccaggcaggaaaggctcctcaagaggttcctggtggtctggcctaagccccagccagaggccctgctctctctggcctggggcatccacccgttgttctgaaggcagagcccattctgtgggctcacaagacacagtgaaggggatcatggcctgcacccctgcttttcagcagtaaaaagcccgaaaagcctggcgagcatggccgagctgggagggccgagccggaactccacgtccctcgagagcaggagcctcttaagggctggcactggtctcagcctaatggctgaggcggtaccctggcttcatatgcatctcactgctcccactgcaggggggcagggaaggggggtctgggagcccttcatgtgtgggggccgagctgggggcccccatggccatcctggacctcgctgctccagagtttaataaaggtagcacatgcttattgctagaaaaaaaaaaaaaaaaaaaaaaaaaaaaaaaaaaaaaaaaaaaaagggcggccgc

SEQ ID NO: 272 - DNA, 1365 bp, Homo sapiens
atgacctggttggtgctgctggggacactgctctgcatgctgcgcgttgggttaggcaccccggactccgagggtttcccgccccgtgcgctccacaactgcccctacaaatgtatctgcgctgccgacctgctaagctgcactggcctagggctgcaggacgtgccagccgagttacctgccgctactgcggacctcgacctgagccacaacgcgctccagcgcctgcgccccggctggttggcgcccctcttccagctgcgcgccctgcacctagaccacaacgaactagatgcgctgggtcgcggcgtcttcgtcaacgccagcggcctgaggctgctcgatctatcatctaacacgttgcgggcgcttggccgccacgacctcgacgggctgggggcgctggagaagctgcttctgttcaataaccgcttggtgcacttggacgagcatgccttccacggcctgcgcgcgctcagccatctctacctgggctgcaacgaactcgcctcgttctccttcgaccacctgcacggtctgagcgccacccacctgcttactctggacctctcctccaaccggctgggacacatctccgtacctgagctggccgcgctgccggccttcctcaagaacggcctctacttgcacaacaaccctttgccttgcgactgccgcctctaccacctgctacagcgctggcaccagcggggcctgagcgccgtgcgcgactttgcgcgcgagtacgtatgcttggccttcaaggtacccgcgtcccgcgtgcgcttcttccagcacagccgcgtctttgagaactgctcgtcggccccagctcttggcctaaagcggccggaagagcacctgtacgcgctggtgggtcggtccctgaggctttactgcaacaccagcgtcccggccatgcgcattgcctgggtttcgccgcagcaggagcttctcagggcgccaggatcccgcgatggcagcatcgcggtgctggccgacggcagcttggccataggcaacgtacaggagcagcatgcgggactcttcgtgtgcctggccactgggccccgcctgcaccacaaccagacgcacgagtacaacgtgagcgtgcactttccgcgcccagagcccgaggctttcaacacaggcttcaccacactgctgggctgtgccgtgggccttgtgctcgtgctgctctacctgttcgccccaccctgccgctgctgccgccgtgcctgcccgctgccgccgctggccccaaacacccagcccgctccaagagctgagccgcacaagtcctcagtactcagcaccacaccgccagacgcacccagcccgcaaggccaagcgtccacaagcacg

SEQ ID NO: 273 - protein, 455 aa, Homo sapiens
MTWLVLLGTLLCMLRVGLGTPDSEGFPPRALHNCPYKCICAADLLSCTGLGLQDVPAELPAATADLDLSHNALQRLRPGWLAPLFQLRALHLDHNELDALGRGVFVNASGLRLLDLSSNTLRALGRHDLDGLGALEKLLLFNNRLVHLDEHAFHGLRALSHLYLGCNELASFSFDHLHGLSATHLLTLDLSSNRLGHISVPELAALPAFLKNGLYLHNNPLPCDCRLYHLLQRWHQRGLSAVRDFAREYVCLAFKVPASRVRFFQHSRVFENCSSAPALGLKRPEEHLYALVGRSLRLYCNTSVPAMRIAWVSPQQELLRAPGSRDGSIAVLADGSLAIGNVQEQHAGLFVCLATGPRLHHNQTHEYNVSVHFPRPEPEAFNTGFTTLLGCAVGLVLVLLYLFAPPCRCCRRACPLPPLAPNTQPAPRAEPHKSSVLSTTPPDAPSPQGQASTST

SEQ ID NO: 274 - protein, 20 aa, Homo sapiens
MTWLVLLGTLLCMLRVGLGT

SEQ ID NO: 275 - protein, 435 aa, Homo sapiens
PDSEGFPPRALHNCPYKCICAADLLSCTGLGLQDVPAELPAATADLDLSHNALQRLRPGWLAPLFQLRALHLDHNELDALGRGVFVNASGLRLLDLSSNTLRALGRHDLDGLGALEKLLLFNNRLVHLDEHAFHGLRALSHLYLGCNELASFSFDHLHGLSATHLLTLDLSSNRLGHISVPELAALPAFLKNGLYLHNNPLPCDCRLYHLLQRWHQRGLSAVRDFAREYVCLAFKVPASRVRFFQHSRVFENCSSAPALGLKRPEEHLYALVGRSLRLYCNTSVPAMRIAWVSPQQELLRAPGSRDGSIAVLADGSLAIGNVQEQHAGLFVCLATGPRLHHNQTHEYNVSVHFPRPEPEAFNTGFTTLLGCAVGLVLVLLYLFAPPCRCCRRACPLPPLAPNTQPAPRAEPHKSSVLSTTPPDAPSPQGQASTST

SEQ ID NO: 276 - protein, 363 aa, Homo sapiens
PDSEGFPPRALHNCPYKCICAADLLSCTGLGLQDVPAELPAATADLDLSHNALQRLRPGWLAPLFQLRALHLDHNELDALGRGVFVNASGLRLLDLSSNTLRALGRHDLDGLGALEKLLLFNNRLVHLDEHAFHGLRALSHLYLGCNELASFSFDHLHGLSATHLLTLDLSSNRLGHISVPELAALPAFLKNGLYLHNNPLPCDCRLYHLLQRWHQRGLSAVRDFAREYVCLAFKVPASRVRFFQHSRVFENCSSAPALGLKRPEEHLYALVGRSLRLYCNTSVPAMRIAWVSPQQELLRAPGSRDGSIAVLADGSLAIGNVQEQHAGLFVCLATGPRLHHNQTHEYNVSVHFPRPEPEAFNT

SEQ ID NO: 277 - protein, 20 aa, Homo sapiens
GFTTLLGCAVGLVLVLLYLF

SEQ ID NO: 278 - protein, 52 aa, Homo sapiens
APPCRCCRRACPLPPLAPNTQPAPRAEPHKSSVLSTTPPDAPSPQGQASTST

SEQ ID NO: 279 - DNA, 1518 bp, Homo sapiens
gtcgacccacgcgtccggcgaaccccagcgtccgccgacatggcctggaccaagtaccagctgttcctggccgggctcatgcttgttaccggctccatcaacacgctctcggcaaaatgggcggacaatttcatggccgagggctgtggagggagcaaggagcacagcttccagcatcccttcctccaggcagtgggcatgttcctgggagaattctcctgcctggctgccttctacctcctccgatgcagagctgcagggcaatcagactccagcgtagacccccagcagcccttcaaccctcttcttttcctgcccccagcgctctgtgacatgacagggaccagcctcatgtatgtggctctgaacatgaccagtgcctccagcttccagatgctgcggggtgcagtgatcatattcactggcctgttctcggtggccttcctgggccggaggctggtgctgagccagtggctgggcatcctagccaccatcgcggggctggtggtcgtgggcctggctgacctcctgagcaagcacgacagtcagcacaagctcagcgaagtgatcacaggggacctgttgatcatcatggcccagatcatcgttgccatccagatggtgctagaggagaagttcgtctacaaacacaatgtgcacccactgcgggcagttggcactgagggcctctttggctttgtgatcctctccctgctgctggtgcccatgtactacatccccgccggctccttcagcggaaaccctcgtgggacactggaggatgcattggacgccttctgccaggtgggccagcagccgctcattgccgtggcactgctgggcaacatcagcagcattgccttcttcaacttcgcaggcatcagcgtcaccaaggaactgagcgccaccacccgcatggtgttggacagcttgcgcaccgttgtcatctgggcactgagcctggcactgggctgggaggccttccatgcactgcagatccttggcttcctcatactccttataggcactgccctctacaatgggctacaccgtccgctgctgggccgcctgtccaggggccggcccctggcagaggagagcgagcaggagagactgctgggtggcacccgcactcccatcaatgatgccagctgaggttccctggaggcttctactgccacccgggtgctccttctccctgagactgaggccacacaggctggtgggccccgaatgccctatccccaaggcctcaccctgtcccctccctgcagaacccccagggcagctgctgccacagaagataacaacacccaagtcctctttttctcactaccacctgcagggtggtgttacccagcccccacaagcctgagtgcagtggcagacctcagctctctggacccctcctacagcactagagctaaatcatgaagttgaattgtaggaatttaccaccgtagtgtatctgaatcataaactagattatcataaaaaaaaaaaaaaaagggcggccgc

SEQ ID NO: 280 - DNA, 1113 bp, Homo sapiens
atggcctggaccaagtaccagctgttcctggccgggctcatgcttgttaccggctccatcaacacgctctcggcaaaatgggcggacaatttcatggccgagggctgtggagggagcaaggagcacagcttccagcatcccttcctccaggcagtgggcatgttcctgggagaattctcctgcctggctgccttctacctcctccgatgcagagctgcagggcaatcagactccagcgtagacccccagcagcccttcaaccctcttcttttcctgcccccagcgctctgtgacatgacagggaccagcctcatgtatgtggctctgaacatgaccagtgcctccagcttccagatgctgcggggtgcagtgatcatattcactggcctgttctcggtggccttcctgggccggaggctggtgctgagccagtggctgggcatcctagccaccatcgcggggctggtggtcgtgggcctggctgacctcctgagcaagcacgacagtcagcacaagctcagcgaagtgatcacaggggacctgttgatcatcatggcccagatcatcgttgccatccagatggtgctagaggagaagttcgtctacaaacacaatgtgcacccactgcgggcagttggcactgagggcctctttggctttgtgatcctctccctgctgctggtgcccatgtactacatccccgccggctccttcagcggaaaccctcgtgggacactggaggatgcattggacgccttctgccaggtgggccagcagccgctcattgccgtggcactgctgggcaacatcagcagcattgccttcttcaacttcgcaggcatcagcgtcaccaaggaactgagcgccaccacccgcatggtgttggacagcttgcgcaccgttgtcatctgggcactgagcctggcactgggctgggaggccttccatgcactgcagatccttggcttcctcatactccttataggcactgccctctacaatgggctacaccgtccgctgctgggccgcctgtccaggggccggcccctggcagaggagagcgagcaggagagactgctgggtggcacccgcactcccatcaatgatgccagc

SEQ ID NO: 281 - protein, 371 aa, Homo sapiens
MAWTKYQLFLAGLMLVTGSINTLSAKWADNFMAEGCGGSKEHSFQHPFLQAVGMFLGEFSCLAAFYLLRCRAAGQSDSSVDPQQPFNPLLFLPPALCDMTGTSLMYVALNMTSASSFQMLRGAVIIFTGLFSVAFLGRRLVLSQWLGILATIAGLVVVGLADLLSKHDSQHKLSEVITGDLLIIMAQIIVAIQMVLEEKFVYKHNVHPLRAVGTEGLFGFVILSLLLVPMYYIPAGSFSGNPRGTLEDALDAFCQVGQQPLIAVALLGNISSIAFFNFAGISVTKELSATTRMVLDSLRTVVIWALSLALGWEAFHALQILGFLILLIGTALYNGLHRPLLGRLSRGRPLAEESEQERLLGGTRTPINDAS

SEQ ID NO: 282 - protein, 18 aa, Homo sapiens
MAWTKYQLFLAGLMLVTG

SEQ ID NO: 283 - protein, 353 aa, Homo sapiens
SINTLSAKWADNFMAEGCGGSKEHSFQHPFLQAVGMFLGEFSCLAAFYLLRCRAAGQSDSSVDPQQPFNPLLFLPPALCDMTGTSLMYVALNMTSASSFQMLRGAVIIFTGLFSVAFLGRRLVLSQWLGILATIAGLVVVGLADLLSKHDSQHKLSEVITGDLLIIMAQIIVAIQMVLEEKFVYKHNVHPLRAVGTEGLFGFVILSLLLVPMYYIPAGSFSGNPRGTLEDALDAFCQVGQQPLIAVALLGNISSIAFFNFAGISVTKELSATTRMVLDSLRTVVIWALSLALGWEAFHALQILGFLILLIGTALYNGLHRPLLGRLSRGRPLAEESEQERLLGGTRTPINDAS

SEQ ID NO: 284 - protein, 29 aa, Homo sapiens
SINTLSAKWADNFMAEGCGGSKEHSFQHP

SEQ ID NO: 285 - protein, 9 aa, Homo sapiens
NMTSASSFQ

SEQ ID NO: 286 - protein, 14 aa, Homo sapiens
DLLSKHDSQHKLSE

SEQ ID NO: 287 - protein, 27 aa, Homo sapiens
PAGSFSGNPRGTLEDALDAFCQVGQQP

SEQ ID NO: 288 - protein, 7 aa, Homo sapiens
EAFHALQ

SEQ ID NO: 289 - protein, 21 aa, Homo sapiens
FLQAVGMFLGEFSCLAAFYLL

SEQ ID NO: 290 - protein, 21 aa, Homo sapiens
LLFLPPALCDMTGTSLMYVAL

SEQ ID NO: 291 - protein, 19 aa, Homo sapiens
MLRGAVIIFTGLFSVAFLG

SEQ ID NO: 292 - protein, 17 aa, Homo sapiens
WLGILATIAGLVVVGLA

SEQ ID NO: 293 - protein, 17 aa, Homo sapiens
VITGDLLIIMAQIIVAI

SEQ ID NO: 294 - protein, 18 aa, Homo sapiens
GLFGFVILSLLLVPMYYI

SEQ ID NO: 295 - protein, 23 aa, Homo sapiens
LIAVALLGNISSIAFFNFAGISV

SEQ ID NO: 296 - protein, 20 aa, Homo sapiens
MVLDSLRTVVIWALSLALGW

SEQ ID NO: 297 - protein, 17 aa, Homo sapiens
ILGFLILLIGTALYNGL

SEQ ID NO: 298 - protein, 20 aa, Homo sapiens
RCRAAGQSDSSVDPQQPFNP

SEQ ID NO: 299 - protein, 7 aa, Homo sapiens
RRLVLSQ

SEQ ID NO: 300 - protein, 23 aa, Homo sapiens
QMVLEEKFVYKHNVHPLRAVGTE

SEQ ID NO: 301 - protein, 9 aa, Homo sapiens
TKELSATTR

SEQ ID NO: 302 - protein, 35 aa, Homo sapiens
HRPLLGRLSRGRPLAEESEQERLLGGTRTPINDAS

SEQ ID NO: 303 - DNA, 2811 bp, Homo sapiens
gtcgacccacgcgtccgcgggacagctggcctgaagctcagagccggggcgtgcgccatggccccacactgggctgtctggctgctggcagcaaggctgtggggcctgggcattggggctgaggtgtggtggaaccttgtgccgcgtaagacagtgtcttctggggagctggccacggtagtacggcggttctcccagaccggcatccaggacttcctgacactgacgctgacggagcccactgggcttctgtacgtgggcgcccgagaggccctgtttgccttcagcatggaggccctggagctgcaaggagcgatctcctgggaggcccccgtggagaagaagactgagtgtatccagaaagggaagaacaaccagaccgagtgcttcaacttcatccgcttcctgcagccctacaatgcctcccacctgtacgtctgtggcacctacgccttccagcccaagtgcacctacgtcgtgagtgctgccctcctacctcggtgtccccagccccccgccctcctcacccttctctggactcgtggatgtggcccacagagccctgcccttaagcatctcctcatcacctctctctctgtccttagaacatgctcaccttcactttggagcatggagagtttgaagatgggaagggcaagtgtccctatgacccagctaagggccatgctggccttcttgtggatggtgagctgtactcggccacactcaacaacttcctgggcacggaacccattatcctgcgtaacatggggccccaccactccatgaagacagagtacctggccttttggctcaacgaacctcactttgtaggctctgcctatgtacctgagagtgtgggcagcttcacgggggacgacgacaaggtctacttcttcttcagggagcgggcagtggagtccgactgctatgccgagcaggtggtggctcgtgtggcccgtgtctgcaagggcgatatggggggcgcacggaccctgcagaggaagtggaccacgttcctgaaggcgcggctggcatgctctgccccgaactggcagctctacttcaaccagctgcaggcgatgcacaccctgcaggacacctcctggcacaacaccaccttctttggggtttttcaagcacagtggggtgacatgtacctgtcggccatctgtgagtaccagttggaagagatccagcgggtgtttgagggcccctataaggagtaccatgaggaagcccagaagtgggaccgctacactgaccctgtacccaggccctggttgtgatggctgcccagccccgccatgccggggcctaccactgcttttcagaggagcagggggcgcggctggctgctgaaggctaccttgtggctgtcgtggcaggcccgtcggtgaccttggaggcccgggcccccctggaaaacctggggctggtgtggctggcggtggtggccctgggggctgtgtgcctggtgctgctgctgctggtgctgtcattgcgccggcggctgcgggaagagctggagaaaggggccaaggctactgagaggaccttggtgtaccccctggagctgcccaaggagcccaccagtccccccttccggccctgtcctgaaccagatgagaaactttgggatcctgtcggttactactattcagatggctcccttaagatagtacctgggcatgcccggtgccagcccggtggggggcccccttcgccacctccaggcatcccaggccagcctctgccttctccaactcggcttcacctggggggtgggcggaactcaaatgccaatggttacgtgcgcttacaactaggaggggaggaccggggagggctcgggcaccccctgcctgagctcgcggatgaactgagacgcaaactgcagcaacgccagccactgcccgactccaaccccgaggagtcatcagtatgaggggaacccccaccgcgtcggcgggaagcgtgggaggtgtagctcctacttttgcacaggcaccagctacctcagggacatggcacgggcacctgctctgtctgggacagatactgcccagcacccacccggccatgaggacctgctctgctcagcacgggcactgccacttggtgtggctcaccagggcaccagcctcgcagaaggcatcttcctcctctctgtgaatcacagacacgcgggaccccagccgccaaaacttttcaaggcagaagtttcaagatgtgtgtttgtctgtatttgcacatgtgtttgtgtgtgtgtgtatgtgtgtgtgcacgcgcgtgcgcgcttgtggcatagccttcctgtttctgtcaagtcttcccttggcctgggtcctcctggtgagtcattggagctatgaaggggaaggggtcgtatcactttgtctctcctacccccactgccccgagtgtcgggcagcgatgtacatatggaggtggggtggacagggtgctgtgccccttcagagggagtgcagggcttggggtgggcctagtcctgctcctagggctgtgaatgttttcagggtggggggagggagatggagcctcctgtgtgtttggggggaagggtgggtggggcctcccacttggccccggggttcagtggtattttatacttgccttcttcctgtacagggctgggaaaggctgtgtgaggggagagaagggagagggtgggcctgctgtggacaatggcatactctcttccagccctaggaggagggctcctaacagtgtaacttattgtgtccccgcgtatttatttgttgtaaatatttgagatttttatattga

SEQ ID NO: 304 - DNA, 729 bp, Homo sapiens
atggccccacactgggctgtctggctgctggcagcaaggctgtggggcctgggcattggggctgaggtgtggtggaaccttgtgccgcgtaagacagtgtcttctggggagctggccacggtagtacggcggttctcccagaccggcatccaggacttcctgacactgacgctgacggagcccactgggcttctgtacgtgggcgcccgagaggccctgtttgccttcagcatggaggccctggagctgcaaggagcgatctcctgggaggcccccgtggagaagaagactgagtgtatccagaaagggaagaacaaccagaccgagtgcttcaacttcatccgcttcctgcagccctacaatgcctcccacctgtacgtctgtggcacctacgccttccagcccaagtgcacctacgtcgtgagtgctgccctcctacctcggtgtccccagccccccgccctcctcacccttctctggactcgtggatgtggcccacagagccctgcccttaagcatctcctcatcacctctctctctgtccttagaacatgctcaccttcactttggagcatggagagtttgaagatgggaagggcaagtgtccctatgacccagctaagggccatgctggccttcttgtggatggtgagctgtactcggccacactcaacaacttcctgggcacggaacccattatcctgcgtaacatggggccccaccactcca

SEQ ID NO: 305 - protein, 243 aa, Homo sapiens
MAPHWAVWLLAARLWGLGIGAEVWWNLVPRKTVSSGELATVVRRFSQTGIQDFLTLTLTEPTGLLYVGAREALFAFSMEALELQGAISWEAPVEKKTECIQKGKNNQTECFNFIRFLQPYNASHLYVCGTYAFQPKCTYVVSAALLPRCPQPPALLTLLWTRGCGPQSPALKHLLITSLSVLRTCSPSLWSMESLKMGRASVPMTQLRAMLAFLWMVSCTRPHSTTSWARNPLSCVTWGPTTP

SEQ ID NO: 306 - protein, 20 aa, Homo sapiens
MAPHWAVWLLAARLWGLGIG

SEQ ID NO: 307 - protein, 223 aa, Homo sapiens
AEVWWNLVPRKTVSSGELATVVRRFSQTGIQDFLTLTLTEPTGLLYVGAREALFAFSMEALELQGAISWEAPVEKKTECIQKGKNNQTECFNFIRFLQPYNASHLYVCGTYAFQPKCTYVVSAALLPRCPQPPALLTLLWTRGCGPQSPALKHLLITSLSVLRTCSPSLWSMESLKMGRASVPMTQLRAMLAFLWMVSCTRPHSTTSWARNPLSCVTWGPTTP

SEQ ID NO: 308 - DNA, 2498 bp, Homo sapiens
gtcgacccacgcgtccgcggacgcgtgggcgcgcgggggccatccagaccctgcggagagcgaggcccggagcgtcgccgaggtttgagggcgccggagaccgagggcctggcggccgaaggaaccgccccaagaagagcctctggcccgggggctgctggaacatgtgcggggggacacagtttgtttgacagttgccagactatgtttacgcttctggttctactcagccaactgcccacagttaccctggggtttcctcattgcgcaagaggtccaaaggcttctaagcatgcgggagaagaagtgtttacatcaaaagaagaagcaaactttttcatacatagacgccttctgtataatagatttgatctggagctcttcactcccggcaacctagaaagagagtgcaatgaagaactttgcaattatgaggaagccagagagatttttgtggatgaagataaaacgattgcattttggcaggaatattcagctaaaggaccaaccacaaaatcagatggcaacagagagaaaatagatgttatgggccttctgactggattaattgctgctggagtatttttggttatttttggattacttggctactatctttgtatcactaagtgtaataggctacaacatccatgctcttcagccgtctatgaaagggggaggcacactccctccatcattttcagaagacctgaggaggctgccttgtctccattgccgccttctgtggaggatgcaggattaccttcttatgaacaggcagtggcgctgaccagaaaacacagtgtttcaccaccaccaccatatcctgggcacacaaaaggatttagggtatttaaaaaatctatgtctctcccatctcactgactaccttgtcattttggtataagaaatttgtgttatttgataggccgggcatggtggctcatgcctgtaatcccagcactttgggaggccaggagttcgagaccagcctggccaacatggtgaaacccggtctctactaaaaattcaaaaattacctaggcgtcatggggcatgcctgtagtcccacctacttgggaggctgaagcaggagaattgctcgaacctgggaggcagaggttgcagtaagctgagatcacgccactgcattccagcctgggcgacagagcaagactccatctcaaaaataaaataaaaaaagaaagaaagaaaagaagaagaaaagagaagaaggagaaggagatgaaggaggaggaggaggagaaggagaagaagaagaagaagaagaccacaaaagacatgactatccaactttttatgacaaactgcaaggaataaaggaagaataagtccatgtactgtaccacagaagttctgtctgcatcttggacctgaacttgatcattatcagcttgataagagactttttgactctatatccttgcagttaagaagaaagcacttttttgtaatgtttgttttaatggttcaaaaaaaatctttcttataaagagcataggtagaattagtgaactctttggatcctttgtacagataaaggttatagatttcttgtgttgaatattaaaaaagcaaggatgtctaaccattaagattatccaaagtcaggctgggcgcagtggctcacgcctgtaatcccagcactttgggagggataggtgggcggatcacctgaggtcaggagtttgagaccagcctggccaacatggcaaaaccccgtctctacaaaaatacaaaagaaattagccagacatgatggcgggtgcctctaatcccagctactggggaggctgaggtgggagaatcgcttgaactcgggaggtggaggttgtagtgaggcgagattgtgccattgcactccaacctgggcgacagagtgagactccatctcaaaaaaaaaaaaaaaaaaaagattatccaaaaagatattggacctactctttcttaggatttttttggcggggggttagaaatacttcacagaatttgacatttcagtataaatctgtgaccttaatataatcacttggttttatatgttaaattattgcacagcagtcatcatattttgcagagtttagttcttaactcttgctgtcagtcatgttttattataggtagtggggtcagtagttttcttcttctaaaaaatactatttgctatgaagttagttcttcagaagatacaagtttgcaatgaaaaggatttgcaagggttgttatgctatcaaataaacagacctaaaatctaggagacactagaacttaatgaagttgcccctgttactgattagtaaatactcccatcttcgttgcaaaattatctctctgtataactacatatgattattttgaaatttgttaaacttcataagtaatagtttgagaatgtggaaaaagtaatttgcttttctgctcttaaaataatattgattaatgttaccagaaaaaaaaaaaaaaaaaagggcggccgc

SEQ ID NO: 309 - DNA, 678 bp, Homo sapiens
atgtttacgcttctggttctactcagccaactgcccacagttaccctggggtttcctcattgcgcaagaggtccaaaggcttctaagcatgcgggagaagaagtgtttacatcaaaagaagaagcaaactttttcatacatagacgccttctgtataatagatttgatctggagctcttcactcccggcaacctagaaagagagtgcaatgaagaactttgcaattatgaggaagccagagagatttttgtggatgaagataaaacgattgcattttggcaggaatattcagctaaaggaccaaccacaaaatcagatggcaacagagagaaaatagatgttatgggccttctgactggattaattgctgctggagtatttttggttatttttggattacttggctactatctttgtatcactaagtgtaataggctacaacatccatgctcttcagccgtctatgaaagggggaggcacactccctccatcattttcagaagacctgaggaggctgccttgtctccattgccgccttctgtggaggatgcaggattaccttcttatgaacaggcagtggcgctgaccagaaaacacagtgtttcaccaccaccaccatatcctgggcacacaaaaggatttagggtatttaaaaaatctatgtctctcccatctcac

SEQ ID NO: 310 - protein, 226 aa, Homo sapiens
MFTLLVLLSQLPTVTLGFPHCARGPKASKHAGEEVFTSKEEANFFIHRRLLYNRFDLELFTPGNLERECNEELCNYEEAREIFVDEDKTIAFWQEYSAKGPTTKSDGNREKIDVMGLLTGLIAAGVFLVIFGLLGYYLCITKCNRLQHPCSSAVYERGRHTPSIIFRRPEEAALSPLPPSVEDAGLPSYEQAVALTRKHSVSPPPPYPGHTKGFRVFKKSMSLPSH

SEQ ID NO: 311 - protein, 17 aa, Homo sapiens
MFTLLVLLSQLPTVTLG

SEQ ID NO: 312 - protein, 209 aa, Homo sapiens
FPHCARGPKASKHAGEEVFTSKEEANFFIHRRLLYNRFDLELFTPGNLERECNEELCNYEEAREIFVDEDKTIAFWQEYSAKGPTTKSDGNREKIDVMGLLTGLIAAGVFLVIFGLLGYYLCITKCNRLQHPCSSAVYERGRHTPSIIFRRPEEAALSPLPPSVEDAGLPSYEQAVALTRKHSVSPPPPYPGHTKGFRVFKKSMSLPSH

SEQ ID NO: 313 - protein, 96 aa, Homo sapiens
FPHCARGPKASKHAGEEVFTSKEEANFFIHRRLLYNRFDLELFTPGNLERECNEELCNYEEAREIFVDEDKTIAFWQEYSAKGPTTKSDGNREKID

SEQ ID NO: 314 - protein, 25 aa, Homo sapiens
VMGLLTGLIAAGVFLVIFGLLGYYL

SEQ ID NO: 315 - protein, 88 aa, Homo sapiens
CITKCNRLQHPCSSAVYERGRHTPSIIFRRPEEAALSPLPPSVEDAGLPSYEQAVALTRKHSVSPPPPYPGHTKGFRVFKKSMSLPSH

SEQ ID NO: 316 - skipped
  Unknown

SEQ ID NO: 317 - skipped
  Unknown

SEQ ID NO: 318 - skipped
  Unknown

SEQ ID NO: 319 - skipped
  Unknown

SEQ ID NO: 320 - skipped
  Unknown

SEQ ID NO: 321 - skipped
  Unknown

SEQ ID NO: 322 - skipped
  Unknown

SEQ ID NO: 323 - skipped
  Unknown

SEQ ID NO: 324 - DNA, 1432 bp, Homo sapiens
  misc_feature (1)...(1432): n = A,T,C or G
acgcgtccgcacanggccggcgcggctgggagcgggtgggcggccgggaggccggagcagcacggccgcaggacctggagctccggctgcgtcttcccgcagcgctacccgccatgcgcctgccgcgccgggccgcgctggggctcctgccgcttctgctgctgctgccgcccgcgccggaggccgccaagaagccgacgccctgccaccggtgccgggggctggtggacaagtttaaccaggggatggtggacaccgcaaagaagaactttggcggcgggaacacggcttgggaggaaaagacgctgtccaagtacgagtccagcgagattcgcctgctggagatcctggaggggctgtgcgagagcagcgacttcgaatgcaatcagatgctagaggcgcaggaggagcacctggaggcctggtggctgcagctgaagagcgaatatcctgacttattcgagtggttttgtgtgaagacactgaaagtgtgctgctctccaggaacctacggtcccgactgtctcgcatgccagggcggatcccagaggccctgcagcgggaatggccactgcagcggagatgggagcagacagggcgacgggtcctgccggtgccacatggggtaccagggcccgctgtgcactgactgcatggacggctacttcagctcgctccggaacgagacccacagcatctgcacagcctgtgacgagtcctgcaagacgtgctcgggcctgaccaacagagactgcggcgagtgtgaagtgggctgggtgctggacgagggcgcctgtgtggatgtggacgagtgtgcggccgagccgcctccctgcagcgctgcgcagttctgtaagaacgccaacggctcctacacgtgcgaagagtgtgactccagctgtgtgggctgcacaggggaaggcccaggaaactgtaaagagtgtatctctggctacgcgagggagcacggacagtgtgcagatgtggacgagtgctcactagcagaaaaaacctgtgtgaggaaaaacgaaaactgctacaatactccagggagctacgtctgtgtgtgtcctgacggcttcgaagaaacggaagatgcctgtgtgccgccggcagaggctgaagccacagaaggagaaagcccgacacagctgccctcccgcgaagacctgtaatgtgccggacttaccctttaaattattcagaaggatgtcccgtggaaaatgtggccctgaggatgccgtctcctgcagtggacagcggcggggagaggctgcctgctctctaacggttgattctcatttgtcccttaaacagctgcatttcttggttgttcttaaacagacttgtatattttgatacagttctttgtaataaaattgaccattgtaggtaatcaaaaaaaaaaaaaaaaaaagggcggccgctagac

SEQ ID NO: 325 - DNA, 1059 bp, Homo sapiens
atgcgcctgccgcgccgggccgcgctggggctcctgccgcttctgctgctgctgccgcccgcgccggaggccgccaagaagccgacgccctgccaccggtgccgggggctggtggacaagtttaaccaggggatggtggacaccgcaaagaagaactttggcggcgggaacacggcttgggaggaaaagacgctgtccaagtacgagtccagcgagattcgcctgctggagatcctggaggggctgtgcgagagcagcgacttcgaatgcaatcagatgctagaggcgcaggaggagcacctggaggcctggtggctgcagctgaagagcgaatatcctgacttattcgagtggttttgtgtgaagacactgaaagtgtgctgctctccaggaacctacggtcccgactgtctcgcatgccagggcggatcccagaggccctgcagcgggaatggccactgcagcggagatgggagcagacagggcgacgggtcctgccggtgccacatggggtaccagggcccgctgtgcactgactgcatggacggctacttcagctcgctccggaacgagacccacagcatctgcacagcctgtgacgagtcctgcaagacgtgctcgggcctgaccaacagagactgcggcgagtgtgaagtgggctgggtgctggacgagggcgcctgtgtggatgtggacgagtgtgcggccgagccgcctccctgcagcgctgcgcagttctgtaagaacgccaacggctcctacacgtgcgaagagtgtgactccagctgtgtgggctgcacaggggaaggcccaggaaactgtaaagagtgtatctctggctacgcgagggagcacggacagtgtgcagatgtggacgagtgctcactagcagaaaaaacctgtgtgaggaaaaacgaaaactgctacaatactccagggagctacgtctgtgtgtgtcctgacggcttcgaagaaacggaagatgcctgtgtgccgccggcagaggctgaagccacagaaggagaaagcccgacacagctgccctcccgcgaagacctg

SEQ ID NO: 326 - protein, 353 aa, Homo sapiens
MRLPRRAALGLLPLLLLLPPAPEAAKKPTPCHRCRGLVDKFNQGMVDTAKKNFGGGNTAWEEKTLSKYESSEIRLLEILEGLCESSDFECNQMLEAQEEHLEAWWLQLKSEYPDLFEWFCVKTLKVCCSPGTYGPDCLACQGGSQRPCSGNGHCSGDGSRQGDGSCRCHMGYQGPLCTDCMDGYFSSLRNETHSICTACDESCKTCSGLTNRDCGECEVGWVLDEGACVDVDECAAEPPPCSAAQFCKNANGSYTCEECDSSCVGCTGEGPGNCKECISGYAREHGQCADVDECSLAEKTCVRKNENCYNTPGSYVCVCPDGFEETEDACVPPAEAEATEGESPTQLPSREDL

SEQ ID NO: 327 - protein, 24 aa, Homo sapiens
MRLPRRAALGLLPLLLLLPPAPEA

SEQ ID NO: 328 - protein, 329 aa, Homo sapiens
AKKPTPCHRCRGLVDKFNQGMVDTAKKNFGGGNTAWEEKTLSKYESSEIRLLEILEGLCESSDFECNQMLEAQEEHLEAWWLQLKSEYPDLFEWFCVKTLKVCCSPGTYGPDCLACQGGSQRPCSGNGHCSGDGSRQGDGSCRCHMGYQGPLCTDCMDGYFSSLRNETHSICTACDESCKTCSGLTNRDCGECEVGWVLDEGACVDVDECAAEPPPCSAAQFCKNANGSYTCEECDSSCVGCTGEGPGNCKECISGYAREHGQCADVDECSLAEKTCVRKNENCYNTPGSYVCVCPDGFEETEDACVPPAEAEATEGESPTQLPSREDL

SEQ ID NO: 329 - DNA, 2730 bp, Homo sapiens
gtcgacccacgcgtccgtcctgcggccccagcctctcctcacgctcgcgcagtctccgccgcagtctcagctgcagctgcaggactgagccgtgcacccggaggagacccccggaggaggcgacaaacttcgcagtgccgcgacccaaccccagccctgggtagcctgcagcatggcccagctgttcctgcccctgctggcagccctggtcctggcccaggctcctgcagctttagcagatgttctggaaggagacagctcagaggaccgcgcttttcgcgtgcgcatcgcgggcgacgcgccactgcagggcgtgctcggcggcgccctcaccatcccttgccacgtccactacctgcggccaccgccgagccgccgggctgtgctgggctctccgcgggtcaagtggactttcctgtcccggggccgggaggcagaggtgctggtggcgcggggagtgcgcgtcaaggtgaacgaggcctaccggttccgcgtggcactgcctgcgtacccagcgtcgctcaccgacgtctccctggcgctgagcgagctgcgccccaacgactcaggtatctatcgctgtgaggtccagcacggcatcgatgacagcagcgacgctgtggaggtcaaggtcaaaggggtcgtctttctctaccgagagggctctgcccgctatgctttctccttttctggggcccaggaggcctgtgcccgcattggagcccacatcgccaccccggagcagctctatgccgcctaccttgggggctatgagcaatgtgatgctggctggctgtcggatcagaccgtgaggtatcccatccagaccccacgagaggcctgttacggagacatggatggcttccccggggtccggaactatggtgtggtggacccggatgacctctatgatgtgtactgttatgctgaagacctaaatggagaactgttcctgggtgaccctccagagaagctgacattggaggaagcacgggcgtactgccaggagcggggtgcagagattgccaccacgggccaactgtatgcagcctgggatggtggcctggaccactgcagcccagggtggctagctgatggcagtgtgcgctaccccatcgtcacacccagccagcgctgtggtgggggcttgcctggtgtcaagactctcttcctcttccccaaccagactggcttccccaataagcacagccgcttcaacgtctactgcttccgagactcggcccagccttctgccatccctgaggcctccaacccagcctccaacccagcctctgatggactagaggctatcgtcacagtgacagagaccctggaggaactgcagctgcctcaggaagccacagagagtgaatcccgtggggccatctactccatccccatcatggaggacggaggaggtggaagctccactccagaagacccagcagaggcccctaggacgctcctagaatttgaaacacaatccatggtaccgcccacggggttctcagaagaggaaggtaaggcattggaggaagaagagaaatatgaagatgaagaagagaaagaggaggaagaagaagaggaggaggtggaggatgaggctctgtgggcatggcccagcgagctcagcagcccgggccctgaggcctctctccccactgagccagcagcccaggagaagtcactctcccaggcgccagcaagggcagtcctgcagcctggtgcatcaccacttcctgatggagagtcagaagcttccaggcctccaagggtccatggaccacctactgagactctgcccactcccagggagaggaacctagcatccccatcaccttccactctggttgaggcaagagaggtgggggaggcaactggtggtcctgagctatctggggtccctcgaggagagagcgaggagacaggaagctccgagggtgccccttccctgcttccagccacacgggcccctgagggtaccagggagctggaggccccctctgaagataattctggaagaactgccccagcagggacctcagtgcaggcccagccagtgctgcccactgacagcgccagccgaggtggagtggccgtggtccccgcatcaggtaattctgcccaaggctcaactgccctctctatcctactccttttcttccccctgcagctctgggtcacctgacctgtagtcctttaacccaccatcatcccaaactctcctgtcctttgccttcattctcttacccacctctacctatgggtctccaatctcggatatccaccttgtgggtatctcagctctccgcgtctttaccctgtgatcccagccccgccactgaccatctgtgacccttccctgccattgggccctccacctgtggctcacatctcgccagccccacagagcatcctcaggcctctccaagggtcctcatcacctattgcagccttcagggctcggcctattttccactactcccttcatccgcctgtgtgccgtcccctttagctgcctcctattgatctcagggaagcctgggagtcccttctcacccctcaacctccggagtccaggagaacccgtacccccacagagccttaagcaactacttctgtgaagtattttttgactgtttcatggaaaacaagccttggaaataaatctctattaaaccgctttgtaaccaaaaaaaaaaaaaaaaaaaaaaaaaaaagggcggccgc

SEQ ID NO: 330 - DNA, 2013 bp, Homo sapiens
atggcccagctgttcctgcccctgctggcagccctggtcctggcccaggctcctgcagctttagcagatgttctggaaggagacagctcagaggaccgcgcttttcgcgtgcgcatcgcgggcgacgcgccactgcagggcgtgctcggcggcgccctcaccatcccttgccacgtccactacctgcggccaccgccgagccgccgggctgtgctgggctctccgcgggtcaagtggactttcctgtcccggggccgggaggcagaggtgctggtggcgcggggagtgcgcgtcaaggtgaacgaggcctaccggttccgcgtggcactgcctgcgtacccagcgtcgctcaccgacgtctccctggcgctgagcgagctgcgccccaacgactcaggtatctatcgctgtgaggtccagcacggcatcgatgacagcagcgacgctgtggaggtcaaggtcaaaggggtcgtctttctctaccgagagggctctgcccgctatgctttctccttttctggggcccaggaggcctgtgcccgcattggagcccacatcgccaccccggagcagctctatgccgcctaccttgggggctatgagcaatgtgatgctggctggctgtcggatcagaccgtgaggtatcccatccagaccccacgagaggcctgttacggagacatggatggcttccccggggtccggaactatggtgtggtggacccggatgacctctatgatgtgtactgttatgctgaagacctaaatggagaactgttcctgggtgaccctccagagaagctgacattggaggaagcacgggcgtactgccaggagcggggtgcagagattgccaccacgggccaactgtatgcagcctgggatggtggcctggaccactgcagcccagggtggctagctgatggcagtgtgcgctaccccatcgtcacacccagccagcgctgtggtgggggcttgcctggtgtcaagactctcttcctcttccccaaccagactggcttccccaataagcacagccgcttcaacgtctactgcttccgagactcggcccagccttctgccatccctgaggcctccaacccagcctccaacccagcctctgatggactagaggctatcgtcacagtgacagagaccctggaggaactgcagctgcctcaggaagccacagagagtgaatcccgtggggccatctactccatccccatcatggaggacggaggaggtggaagctccactccagaagacccagcagaggcccctaggacgctcctagaatttgaaacacaatccatggtaccgcccacggggttctcagaagaggaaggtaaggcattggaggaagaagagaaatatgaagatgaagaagagaaagaggaggaagaagaagaggaggaggtggaggatgaggctctgtgggcatggcccagcgagctcagcagcccgggccctgaggcctctctccccactgagccagcagcccaggagaagtcactctcccaggcgccagcaagggcagtcctgcagcctggtgcatcaccacttcctgatggagagtcagaagcttccaggcctccaagggtccatggaccacctactgagactctgcccactcccagggagaggaacctagcatccccatcaccttccactctggttgaggcaagagaggtgggggaggcaactggtggtcctgagctatctggggtccctcgaggagagagcgaggagacaggaagctccgagggtgccccttccctgcttccagccacacgggcccctgagggtaccagggagctggaggccccctctgaagataattctggaagaactgccccagcagggacctcagtgcaggcccagccagtgctgcccactgacagcgccagccgaggtggagtggccgtggtccccgcatcaggtaattctgcccaaggctcaactgccctctctatcctactccttttcttccccctgcagctctgggtcacc

SEQ ID NO: 331 - protein, 671 aa, Homo sapiens
MAQLFLPLLAALVLAQAPAALADVLEGDSSEDRAFRVRIAGDAPLQGVLGGALTIPCHVHYLRPPPSRRAVLGSPRVKWTFLSRGREAEVLVARGVRVKVNEAYRFRVALPAYPASLTDVSLALSELRPNDSGIYRCEVQHGIDDSSDAVEVKVKGVVFLYREGSARYAFSFSGAQEACARIGAHIATPEQLYAAYLGGYEQCDAGWLSDQTVRYPIQTPREACYGDMDGFPGVRNYGVVDPDDLYDVYCYAEDLNGELFLGDPPEKLTLEEARAYCQERGAEIATTGQLYAAWDGGLDHCSPGWLADGSVRYPIVTPSQRCGGGLPGVKTLFLFPNQTGFPNKHSRFNVYCFRDSAQPSAIPEASNPASNPASDGLEAIVTVTETLEELQLPQEATESESRGAIYSIPIMEDGGGGSSTPEDPAEAPRTLLEFETQSMVPPTGFSEEEGKALEEEEKYEDEEEKEEEEEEEEVEDEALWAWPSELSSPGPEASLPTEPAAQEKSLSQAPARAVLQPGASPLPDGESEASRPPRVHGPPTETLPTPRERNLASPSPSTLVEAREVGEATGGPELSGVPRGESEETGSSEGAPSLLPATRAPEGTRELEAPSEDNSGRTAPAGTSVQAQPVLPTDSASRGGVAVVPASGNSAQGSTALSILLLFFPLQLWVT

SEQ ID NO: 332 - protein, 22 aa, Homo sapiens
MAQLFLPLLAALVLAQAPAALA

SEQ ID NO: 333 - protein, 649 aa, Homo sapiens
DVLEGDSSEDRAFRVRIAGDAPLQGVLGGALTIPCHVHYLRPPPSRRAVLGSPRVKWTFLSRGREAEVLVARGVRVKVNEAYRFRVALPAYPASLTDVSLALSELRPNDSGIYRCEVQHGIDDSSDAVEVKVKGVVFLYREGSARYAFSFSGAQEACARIGAHIATPEQLYAAYLGGYEQCDAGWLSDQTVRYPIQTPREACYGDMDGFPGVRNYGVVDPDDLYDVYCYAEDLNGELFLGDPPEKLTLEEARAYCQERGAEIATTGQLYAAWDGGLDHCSPGWLADGSVRYPIVTPSQRCGGGLPGVKTLFLFPNQTGFPNKHSRFNVYCFRDSAQPSAIPEASNPASNPASDGLEAIVTVTETLEELQLPQEATESESRGAIYSIPIMEDGGGGSSTPEDPAEAPRTLLEFETQSMVPPTGFSEEEGKALEEEEKYEDEEEKEEEEEEEEVEDEALWAWPSELSSPGPEASLPTEPAAQEKSLSQAPARAVLQPGASPLPDGESEASRPPRVHGPPTETLPTPRERNLASPSPSTLVEAREVGEATGGPELSGVPRGESEETGSSEGAPSLLPATRAPEGTRELEAPSEDNSGRTAPAGTSVQAQPVLPTDSASRGGVAVVPASGNSAQGSTALSILLLFFPLQLWVT

SEQ ID NO: 334 - protein, 456 aa, Pigeon pea witches'-broom phytoplasma
MNLDIHCEQLSDARWTELLPLLQQYEVVRLDDCGLTEEHCKDIGSALRANPSLTELCLRTNELGDAGVHLVLQGLQSPTCKIQKLSLQNCSLTEAGCGVLPSTLRSLPTLRELHLSDNPLGDAGLRLLCEGLLDPQCHLEKLQLEYCRLTAASCEPLASVLRATRALKELTVSNNDIGEAGARVLGQGLADSACQLETLRLENCGLTPANCKDLCGIVASQASLRELDLGSNGLGDAGIAELCPGLLSPASRLKTLWLWECDITASGCRDLCRVLQAKETLKELSLAGNKLGDEGARLLCESLLQPGCQLESLWVKSCSLTAACCQHVSLMLTQNKHLLELQLSSNKLGDSGIQELCQALSQPGTTLRVLCLGDCEVTNSGCSSLASLLLANRSLRELDLSNNCVGDPGVLQLLGSLEQPGCALEQLVLYDTYWTEEVEDRLQALEGSKPGLRVIS

SEQ ID NO: 335 - protein, 834 aa, Mus sp.
MAPHWAVWLLAAGLWGLGIGAEMWWNLVPRKTVSSGELVTVVRRFSQTGIQDFLTLTLTEHSGLLYVGAREALFAFSVEALELQGAISWEAPAEKKIECTQKGKSNQTECFNFIRFLQPYNSSHLYVCGTYAFQPKCTYINMLTFTLDRAEFEDGKGKCPYDPAKGHTGLLVDGELYSATLNNFLGTEPVILRYMGTHHSIKTEYLAFWLNEPHFVGSAFVPESVGSFTGDDDKIYFFFSERAVEYDCYSEQVVARVARVCKGDMGGARTLQKKWTTFLKARLVCSAPDWKVYFNQLKAVHTLRGASWHNTTFFGVFQARWGDMDLSAVCEYQLEQIQQVFEGPYKEYSEQAQKWARYTDPVPSPRPGSCINNWHRDNGYTSSLELPDNTLNFIKKHPLMEDQVKPRLGRPLLVKKNTNFTHVVADRVPGLDGATYTVLFIGTGDGWLLKAVSLGPWIHMVEELQVFDQEPVESLVLSQSKKVLFAGSRSQLVQLSLADCTKYRFCVDCVLARDPYCAWNVNTSRCVATTSGRSGSFLVQHVANLDTSKMCNQYGIKKVRSIPKNITVVSGTDLVLPCHLSSNLAHAHWTFGSQDLPAEQPGSFLYDTGLQALVVMAAQSRHSGPYRCYSEEQGTRLAAESYLVAVVAGSSVTLEARAPLENLGLVWLAVVALGAVCLVLLLLVLSLRRRLREELEKGAKASERTLVYPLELPKEPASPPFRPGPETDEKLWDPVGYYYSDGSLKIVPGHARCQPGGGPPSPPPGIPGQPLPSPTRLHLGGGRNSNANGYVRLQLGGEDRGGSGHPLPELADELRRKLQQRQPLPDSNPEESSV

SEQ ID NO: 336 - DNA, 3503 bp, Mus sp.
ggcacgaggtggccggagtcaaacgcgagggcagcgccagggattggagctgcacgaaagagggctgctggactgaagtttagaccctgggtgtctgccatggccccacactgggctgtctggctgctggcagcagggctgtggggcctgggcatcggggctgagatgtggtggaaccttgtgccccggaagacagtatcttctggggagctggtcacagtagtgaggcggttctcccagacaggcatccaggacttcctgacactgaccctgacagaacattctggccttttatatgtgggggcccgagaggcgctgtttgccttcagtgtagaggctctggagctgcaaggagcgatctcttgggaggctccagctgagaagaaaattgaatgtacccagaaagggaagagcaaccagaccgaatgcttcaacttcatccgcttccttcagccatacaattcctcccatctgtatgtctgcggcacctatgccttccagcccaagtgcacctacatcaacatgctcacgttcaccttggaccgtgcagaatttgaggatgggaagggtaaatgcccatatgacccagctaagggtcacaccggactccttgtggacggtgagctgtactcagccacactcaataacttcctgggcacagagccggttatccttcgatacatggggacccaccactccatcaagacagagtacctggctttttggctgaatgaaccccactttgtaggctctgcctttgtccctgagagtgtgggaagcttcacgggagacgatgacaagatctacttcttcttcagtgagcgggcagtggagtatgactgctattccgagcaggtggtggctcgtgtggcgagagtctgtaagggtgacatggggggagcacggacgctgcagaagaaatggacgacgttcctgaaggctcggttggtgtgctcagcccctgactggaaggtctacttcaaccagctgaaggcggtgcacaccctgcggggcgcctcttggcacaacaccaccttcttcggggtttttcaagcgcgatggggcgatatggacctgtctgcagtttgtgagtaccagttggaacagatccagcaagtgtttgagggtccctacaaggagtacagtgagcaagcccagaagtgggcccgctatactgacccggtacccagccctcggcctggttcgtgtatcaacaactggcaccgagacaatggctacaccagttccctggaactgccggacaacaccctcaacttcatcaagaagcaccccctgatggaggaccaggtgaagcctcggttgggccgccccctacttgtgaagaagaacactaacttcacacacgtggtggccgacagggtcccagggcttgatggtgccacctatacagtgttgttcattggtacaggagatggctggctgctgaaggctgtgagcctggggccctggatccacatggtggaggaactgcaggtgtttgaccaggagccagtggaaagtctggtgctgtctcagagcaagaaggtgctctttgctggctcccgctctcagctggttcagctgtctctggccgactgcacaaagtaccgtttctgtgtagactgtgtcctggccagggacccttactgtgcctggaatgtcaacaccagccgctgtgtggccaccaccagtggtcgctcggggtcctttctggtccaacatgtggcgaacttggacacttcaaagatgtgtaaccagtatggcattaaaaaagtcagatctattcccaagaacatcaccgttgtgtcaggcacagacctggtcctaccctgccacctctcgtccaatttggcccatgcccactggaccttcggaagccaggacctgcctgcagaacaacctggctcctttctttatgacacgggactccaggcgctggtggtgatggccgcacagtcccgtcactctggaccctatcgttgctattcagaggagcaggggacaagactggctgcagaaagctaccttgttgctgtcgtggccggctcgtcggtgacactggaggcacgggctcccttggaaaacctggggctcgtgtggctcgctgtggtggccctgggggctgtgtgcctggtgctgctgctgctggtcctatcgctccgccggcgacttcgagaagagctagaaaagggtgccaaggcatctgagaggacactggtgtaccccttggaactgcccaaggagcctgccagtccccccttccgtcctggccccgaaactgatgagaaactttgggatcctgtcgggtactactattcggatggctctctcaagattgtgcctggtcacgcccggtgccagcctgggggtgggcccccttccccacctcctggcatacctggccagcctctgccttctccaactcggctccacctaggaggtggtcggaactcaaatgccaatggttatgtgcgtttacagttgggcggagaggaccgaggaggatctgggcacccactgcctgagctcgcggatgaattacgacggaaactacaacagcgccagccgctgcctgactccaacccagaggagtcttcagtatgaggggacccccccacctcattggcgggggggggtctcatgggaggtgcactcttaacttttgcacaggcaccagctacctcagggacatggcaggggcacttgctctgcctgggacagacactgcccatcatttgcccggccgtgaggacctgctcagcatgggcactgccacttggtgtggctcaccaggacttcagcctcacaggagacacaccctcctctgtgaatttgagacatgtgggaccccagcagccaaaactttgcaaggaagaggtttcaagatgtgggcgtgtttgtgcatatatgtgttggtatgcatgtggaagaatgtgtgtgtgtgtgtgtgtgtgttgtaactttcctgtctctatcacgtcttcccttggcctggggtcctcctggttgagtctttggagctatgaaggggaagggggtcatagcactttgcttctcctacccccagctgtcccaagctttggggcagtgatgtacatacggggaagggaaggacagggtgttgtaccccttttgggggagtgcgggactcgggggtgggcctagccctgctcctagggctgtgaatgttttcagggcgggggttgggggtggagatggaacctcctgcttcagggggaggggtgggcagggcctcccacttgccctccgggttcggtggtattttatatttgcgctcttctgacagggctgggaagggttgttgggggagggaagggaggaggtgggcatgctatggatactggcctatcctctccctgctctgggaaaagggctaacagtgtaacttattgtgtccccacatatttatttgttgtaaatatttgagtatttttatattgacaaataaaatggagaaaatgaaatttaaaaaaaaaaaaaaa

SEQ ID NO: 337 - skipped
  Unknown

SEQ ID NO: 338 - skipped
  Unknown

SEQ ID NO: 339 - protein, 348 aa, Cricetulus griseus
MHLPPAAAVGLLLLLLPPPARVASRKPTMCQRCRALVDKFNQGMANTARKNFGGGNTAWEEKSLSKYEFSEIRLLEIMEGLCDSNDFECNQLLEQHEEQLEAWWQTLKKECPNLFEWFCVHTLKACCLPGTYGPDCQECQGGSQRPCSGNGHCDGDGSRQGDGSCQCHVGYKGPLCIDCMDGYFSLLRNETHSFCTACDESCKTCSGPTNKGCVECEVGWTRVEDACVDVDECAAETPPCSNVQYCENVNGSYTCEECDSTCVGCTGKGPANCKECISGYSKQKGECADIDECSLETKVCKKENENCYNTPGSFVCVCPEGFEEDRRCLCTDSRRRSGRGKSHTATLP

SEQ ID NO: 340 - DNA, 1399 bp, Cricetulus griseus
gtagccgggggaacggccggcgcgcttgccggtgggcggaggcgagactccacagcagttctctgccggtcgcccgcgagtgcacccgccatgcacctgccgcccgctgccgcagtcgggctgctactgctgctgctgccgcctcccgcgcgcgtggcctcccggaagccgacaatgtgccagaggtgccgggcgctggtggacaagttcaaccaggggatggccaacacggccaggaagaatttcggcggcggcaacacggcgtgggaggagaagagtctgtccaagtacgaattcagtgagattcggctcctggagattatggagggcctgtgtgacagcaacgactttgaatgcaaccaactcttggaacagcatgaggagcagctagaggcctggtggcagacactgaagaaggagtgccctaacctatttgagtggttctgtgtacacacactgaaagcatgctgtcttccaggcacctatgggccagactgtcaggaatgccagggtgggtctcagaggccttgtagcgggaatggccactgcgacggagatggcagcagacagggcgacgggtcctgccagtgtcacgtaggatacaaggggccgctgtgtatcgactgcatggatggctacttcagcttgctgaggaacgagacccacagcttctgcacagcctgtgatgagtcctgcaagacatgctcaggtccaaccaacaaaggctgtgtggagtgcgaagtgggctggacacgtgtggaggatgcctgtgtggatgttgacgagtgtgcagcagagaccccaccctgcagcaatgtacagtactgtgaaaatgtcaacggctcctacacatgtgaagagtgtgattctacctgtgtgggctgcacaggaaaaggcccagccaattgtaaagagtgtatctctggctacagcaagcagaaaggagagtgtgcagatatagatgaatgctcattagaaacaaaggtgtgtaagaaggaaaatgagaactgctacaatactccagggagctttgtctgcgtgtgtccggaaggtttcgaggaagacagaagatgcttgtgtacagacagcagaaggcgaagtggcagaggaaagtcccacacagccaccctcccatgaggatttgtgacgggcatccaggttcagaagctggactctcacccttttaagttattgagaggacatcctatagaaaatgtggcccatggacatcaaccccatttctccaggaagttttggaggaagaagctgcctgctttgaaacagtagatactcacttggccctttaaaacgctgcatttcttggtggttcttaaacagattcgtatattttgatactgttctttataataaaattgatcattgaaggtcaccaggaaca

SEQ ID NO: 341 - protein, 528 aa, Homo sapiens
MAQLFLPLLAALVLAQAPAALADVLEGDSSEDRAFRVRIAGDAPLQGVLGGALTIPCHVHYLRPPPSRRAVLGSPRVKWTFLSRGREAEVLVARGVRVKVNEAYRFRVALPAYPASLTDVSLALSELRPNDSGIYRCEVQHGIDDSSDAVESSQRYPIQTPREACYGDMDGFPGVRNYGVVDPDDLYDVYCYAEDLNGELFLGDPPEKLTLEEARAYCQERGAEIATTGQLYAAWDGGLDHCSPGWLADGSVRYPIVTPSQRCGGGLPGVKTLFLFPNQTGFPNKHSRFNVYCFRDSAQLLPSLRPPTQPPTQLDGLEAIVTVTETLEELQLPQEATESESRGAIYSIPIMEDGGGGSSTPEDPAEAPRTLLEFETQSMVPPTGFSEEEGKALEEEEKYEDEEEKEEEEEEEEVEDEALWAWPSELSSPGPEASLPTEPAAQEESLSQAPARAVLQPGASPLPDGESEASRPPRVHGPPTETLPTPRERNLASPSPSTLVEAREVGEATGGPELSGVPRGGARTQFAL

SEQ ID NO: 342 - protein, 883 aa, Mus sp.
MIPLLLSLLAALVLTQAPAALADDLKEDSSEDRAFRVRIGAAQLRGVLGGALAIPCHVHHLRPPRSRRAAPGFPRVKWTFLSGDREVEVLVARGLRVKVNEAYRFRVALPAYPASLTDVSLVLSELRPNDSGVYRCEVQHGIDDSSDAVEVKVKGVVFLYREGSARYAFSFAGAQEACARIGARIATPEQLYAAYLGGYEQCDAGWLSDQTVRYPIQNPREACSGDMDGYPGVRNYGVVGPDDLYDVYCYAEDLNGELFLGAPPSKLTWEEARDYCLERGAQIASTGQLYAAWNGGLDRCSPGWLADGSVRYPIITPSQRCGGGLPGVKTLFLFPNQTGFPSKQNRFNVYCFRDSAHPSASSEASSPASDGLEAIVTVTEKLEELQLPQEAMESESRGAIYSIPISEDGGGGSSTPEDPAEAPRTPLESETQSIAPPTESSEEEGVALEEEERFKDLEALEEEKEQEDLWVWPRELSSPLPTGSETEHSLSQVSPPAQAVLQLDASPSPGPPRFRGPPAETLLPPREWSATSTPGGAREVGGETGSPELSGVPRESEEAGSSSLEDGPSLLPATWAPVGPRELETPSEEKSGRTVLAGTSVQAQPVLPTDSASHGGVAVAPSSGDCIPSPCHNGGTCLEEKEGFRCLCLPGYGGDLCDVGLHFCSPGWEAFQGACYKHFSTRRSWEEAESQCRALGAHLTSICTPEEQDFVNDRYREYQWIGLNDRTIEGDFLWSDGAPLLYENWNPGQPDSYFLSGENCVVMVWHDQGQWSDVPCNYHLSYTCKMGLVSCGPPPQLPLAQIFGRPRLRYAVDTVLRYRCRDGLAQRNLPLIRCQENGLWEAPQISCVPRRPGRALRSMDAPEGPRGQLSRHRKAPLTPPSSL

SEQ ID NO: 343 - DNA, 3153 bp, Mus sp.
  misc_feature (1)...(3153): n = A,T,C or G
gaggctcccggcgagctggcgcccctgtctgggtcccgcgcgcccggccctgctcgcgcccgcgcatcgcgccgcagtctcggtctgcggctgcgggacgtgacggcgtgcgcggaggggacctcgcaagttcttccatcagtgtgcagaatgataccactgcttctgtccctgctggccgctctggtcctgacccaagcccctgccgccctcgctgatgacctgaaagaagacagctcggaggatcgagccttccgcgtgcgcatcggtgccgcgcagctgcggggcgtgctgggcggtgccctggccatcccatgccacgtccaccacctgcggccgccgcgcagccgccgggccgcgccgggttttccccgggtcaagtggaccttcctgtccggggaccgggaggtagaggttctggtggctcgcgggctgcgcgtcaaggtaaacgaagcctaccggttccgcgtggcgctgcctgcctaccccgcatcgctcacggatgtgtctctagtattgagcgaactgcggcccaatgattccggggtctatcgctgcgaggtccagcacggtatcgacgacagcagtgatgctgtggaggtcaaggtcaaaggggtcgtcttcctctacagagagggctctgcgcgctatgctttctccttcgctggagcccaggaagcctgcgctcgcataggagcccgaatcgccaccccggagcagctctatgctgcctacctcggcggctatgagcagtgtgatgcaggctggctgtccgaccaaactgtgaggtaccccatccagaacccacgagaggcctgctctggagacatggatggctatcctggcgtgcggaactacggagtggtgggtcctgatgatctctatgatgtctactgttatgccgaagacctaaatggagaactgttcctaggcgcccctcccagcaagctgacatgggaggaggctcgggactactgtctggaacgtggtgcacagatcgctagcacaggccagctgtacgcagcctggaatggtggcctggacagatgtagccctggctggctggctgatggcagcgtgcgctatcccatcatcacacccagccaacgctgtgggggcggcctgccaggagtcaagaccctcttcctctttcccaaccagactggcttccccagcaagcagaaccgcttcaatgtctactgcttccgagactctgcccatccctctgcttcctctgaggcctctagcccagcctcagatggacttgaggccattgtcacagtgacagaaaagctggaggaactgcagctgcctcaggaagcgatggagagcgagtctcgtggggccatctactccatccccatctcagaagatgggggaggaggaagctccaccccagaagacccagcagaggcccccaggactccgctagaatcggaaacccaatccattgcaccacctaccgagtcctcagaagaggaaggcgtagccctggaggaagaagaaagattcaaagacttggaggctctggaggaagagaaggagcaggaggacctgtgggtgtggcccagagagctcagcagccctctccctactggctcagaaacagagcattcactctcccaggtgtccccaccagcccaggcagttctacagctggatgcgtcaccttctcctgggcctccaaggttccgtggaccgcctgcagagactttgctccccccgagggagtggagcgccacatctactcctggtggggcaagagaagtagggggggaaactgggagccctgagctctctggggttcctcgagagagcgaggaggcagggagctccagcttggaggatggcccttccctacttccagctacatgggcccctgtgggtcccagggagctggagaccccctcagaagagaagtctggaagaactgtcctggcaggcacctcagtgcaggcccagccagtgctgcccaccgacagtgccagccacggtggagtggctgtggctccctcatcaggtgactgtatccccagcccctgccacaatggtgggacatgcttggaggagaaggagggtttccgctgcctatgtttgccaggctatgggggggacctgtgcgatgttggccttcatttctgcagccctggctgggaggccttccagggagcctgctacaagcacttttccacacgaaggagttgggaggaggcagaaagtcagtgccgagcgctaggtgctcatctgaccagcatctgcacccctgaggagcaagactttgtcaatgatcgataccgggagtaccagtggattgggctcaatgacaggaccatcgagggtgacttcttgtggtcagatggtgcccctctgctctatgaaaactggaaccctgggcagcctgacagctacttcctgtctggggagaactgtgtggtcatggtgtggcatgaccagggacagtggagtgatgtgccctgcaactaccatctatcctacacctgcaagatggggcttgtgtcctgtgggcctccaccacagctacccctggctcaaatatttggtcgccctcggctgcgctacgcggtggatactgtgcttcgatatcgatgccgagacgggctggctcagcgcaacctgccgttgatccgctgccaggagaatgggctttgggaggcccctcagatttcctgtgtaccccggaggcctggccgtgctctgcgctccatggacgccccagaaggaccacggggacagctctcgaggcacaggaaggcaccgttgacaccgccctccagtctctagggagcctggaagactgctgcccccagcaggaccctctcacatcaactgccagtgctcttccccatgatagggggtgacgtgagaggggtgggactgaaattcagaggacagcgctcgaaggggtttctgggaaacacttgggtggctccgccccctcacacaagggcctcaggttttacccggtaagtccctaagtgcctcaactgccctctcatgtcagctgcctccttgtccctcgatntcgtnaggggacactgtgctattcgatcttgattgtcgaagagtttttaggatggagtaccagcaaaaccaggtggaaataaagttgtctgaacccaaagaaaaaaaaaa

SEQ ID NO: 344 - skipped
  Unknown

SEQ ID NO: 345 - skipped
  Unknown

SEQ ID NO: 346 - skipped
  Unknown

SEQ ID NO: 347 - skipped
  Unknown

SEQ ID NO: 348 - skipped
  Unknown

SEQ ID NO: 349 - skipped
  Unknown

SEQ ID NO: 350 - skipped
  Unknown

SEQ ID NO: 351 - DNA, 2002 bp, Gerbil
gtcgacccacgcgtccgctgcgttctcacccctggaccaccctgggagaacagttgaccgaagtttgtttggcagttgctgctggactatgtttctgcttctggtggtactcagccagctgcccagacttaccctcgcggttcctcatacaagaagcctaaagaattctgaacatgccccagaaggagtctttgcatcaaaaaaagcagcaagcatctttatgcaccgtcgcctcctatacaatagatttgatttagaactcttcactcccgggaacctggagagagagtgctatgaggagttctgtagttatgaagaagccagagagatcctcggggacaacgaagaaatgatcacattctggcgggaatattcagtcaaaggaccaaccacaagatcagatgtcaacaaagagaaaattgatgttatgggccttctgactggcttaattgcggctggagtattcttggttgtttttggcttacttggttactatctgtgtatcaccaagtgtaataggcagccatatcaaggttcttcagctgtctacacaagaaggaccaggcacacaccgtccatcattttcagaacccatgaggaagctgtcttgtctccatcgtcatcctcagaggacgcgggactaccttcctatgaacaggcagtagctctgaccagaaaacacagtgtctcaccaccacctccatatcctgggccagcaaaaggatttagggtatttaaaaagtcaatgtcactcccatctcactaagcccaccttgccgccttgctgtggtctgaataatatgttcttcctgaaacaacaacaacaaaaaaatttgcctgttcagctttttatgacaaagcacaaggaataaaggaacactatatacagaacagaattcaccacagccccgctttcagctctgcccccaactggattgctgtcttggtaagagacttctaccgtgcttcctcgaagttaagaagaaagtgcctttttgcaatgtaaactgtactggttcaaacattcttgctacagctaggtacctataatccccaccttcaggagacttaggcgggagggatgagagttcaaggccagcctgggccctgtcaggacgctgtctcaaaacaaagtttgttatcaatagaataattagaattaacaaactaggattttcagtcttaagtcatgatattggatcttctcttcagtaaggtttctttttggctagaaatacttcatagaatttgacattttggtatacatctgtggccttgatacaatgacttgattttctgttttaattagtgcagaggattcagcaaatttgcaggtcttcattttgttccctcgctatccatcgatcatgtttcagtgtattaagaggagtcagccaggcgtggtggcccacacctgtgatcccagcacttaggggggcataggcaggcagatctctgtgagctgaaggacagcctggcctacaaagtccaggacaaccgagaccacacagagaaaccttgtcttgaaaaacaaaacaaaaacaagagagagagagagagagagagaaaagagatgtcaagaggtttttgtttttttttttttaaattactatttatgggcctcacttggaaaagtgcttgccatgcaaatagaaggacaggagttcaatcctcattacccacatttgaaacaaataacaagaaaaacaaaccaaaaaaccaaaacaaacaaaatcttgagaacttgagtgaataccggtaacctcagggctaggcactgtaactgaatcaggagcctccagatccagggaaacgctgtctcaacaaataaataaataagtaagtcagtgaggtggtctttaaacccagcacttgagagccaaaggcaggcagagctcagtgagttggagaccagcctggtctacaaagcaagttctaagggagccagggcacagagaaaccctgtctgaaggaaaaaaaaaaaaaaaaaaagggcggccgc

SEQ ID NO: 352 - DNA, 675 bp, Gerbil
atgtttctgcttctggtggtactcagccagctgcccagacttaccctcgcggttcctcatacaagaagcctaaagaattctgaacatgccccagaaggagtctttgcatcaaaaaaagcagcaagcatctttatgcaccgtcgcctcctatacaatagatttgatttagaactcttcactcccgggaacctggagagagagtgctatgaggagttctgtagttatgaagaagccagagagatcctcggggacaacgaagaaatgatcacattctggcgggaatattcagtcaaaggaccaaccacaagatcagatgtcaacaaagagaaaattgatgttatgggccttctgactggcttaattgcggctggagtattcttggttgtttttggcttacttggttactatctgtgtatcaccaagtgtaataggcagccatatcaaggttcttcagctgtctacacaagaaggaccaggcacacaccgtccatcattttcagaacccatgaggaagctgtcttgtctccatcgtcatcctcagaggacgcgggactaccttcctatgaacaggcagtagctctgaccagaaaacacagtgtctcaccaccacctccatatcctgggccagcaaaaggatttagggtatttaaaaagtcaatgtcactcccatctcac

SEQ ID NO: 353 - protein, 225 aa, Gerbil
MFLLLVVLSQLPRLTLAVPHTRSLKNSEHAPEGVFASKKAASIFMHRRLLYNRFDLELFTPGNLERECYEEFCSYEEAREILGDNEEMITFWREYSVKGPTTRSDVNKEKIDVMGLLTGLIAAGVFLVVFGLLGYYLCITKCNRQPYQGSSAVYTRRTRHTPSIIFRTHEEAVLSPSSSSEDAGLPSYEQAVALTRKHSVSPPPPYPGPAKGFRVFKKSMSLPSH

SEQ ID NO: 354 - protein, 17 aa, Gerbil
MFLLLVVLSQLPRLTLA

SEQ ID NO: 355 - protein, 208 aa, Gerbil
VPHTRSLKNSEHAPEGVFASKKAASIFMHRRLLYNRFDLELFTPGNLERECYEEFCSYEEAREILGDNEEMITFWREYSVKGPTTRSDVNKEKIDVMGLLTGLIAAGVFLVVFGLLGYYLCITKCNRQPYQGSSAVYTRRTRHTPSIIFRTHEEAVLSPSSSSEDAGLPSYEQAVALTRKHSVSPPPPYPGPAKGFRVFKKSMSLPSH

SEQ ID NO: 356 - protein, 95 aa, Gerbil
VPHTRSLKNSEHAPEGVFASKKAASIFMHRRLLYNRFDLELFTPGNLERECYEEFCSYEEAREILGDNEEMITFWREYSVKGPTTRSDVNKEKID

SEQ ID NO: 357 - protein, 25 aa, Gerbil
VMGLLTGLIAAGVFLVVFGLLGYYL

SEQ ID NO: 358 - protein, 88 aa, Gerbil
CITKCNRQPYQGSSAVYTRRTRHTPSIIFRTHEEAVLSPSSSSEDAGLPSYEQAVALTRKHSVSPPPPYPGPAKGFRVFKKSMSLPSH

SEQ ID NO: 359 - skipped
  Unknown

SEQ ID NO: 360 - skipped
  Unknown

SEQ ID NO: 361 - skipped
  Unknown

SEQ ID NO: 362 - DNA, 962 bp, Mus sp.
ccgtttctctttaaccacttgcacggtctggggttaacccgcctgcggactctggacctctcctccaactggctgaaacatatctccatccctgagttggctgcactgccaacttatctcaagaacaggctctacctgcacaacaacccgctgccctgtgactgcagcctctaccacctgctccggcgctggcaccagcggggcctgagtgccctgcatgattttgaacgcgagtacacatgcttggtctttaaggtgtcagagtcccgagtgcgcttttttgagcacagccgggtcttcaagaactgctctgtggctgcagctccaggcttagagctgcctgaagagcagctgcacgcgcaggtgggccagtccctgaggctcttctgcaacaccagtgtgcctgccactcgggtggcctgggtctccccgaagaatgagctgcttgtggcgccagcctctcaggatggtagcatcgctgtgttggctgatggcagcttagccataggcagggtgcaagagcagcacgcaggcgtctttgtgtgcctggccagtgggccccgcctgcaccacaaccagacacttgagtacaatgtgagtgtgcaaaaggctcgccccgagccagagactttcaacacaggctttaccaccctgctgggctgtattgtgggcctggtgctggtgttgctctacttgtttgcaccaccctgtcgtggctgctgtcactgctgtcagcgggcctgccgcaaccgttgctggccccgggcatccagtccactccaggagctgagcgcacagtcctccatgcttagcactacgccaccagatgcacccagccgcaaggccagtgtccacaagcatgtggtcttcctggagccgggcaagaagggcctcaatggccgtgtgcagctcgcagtacctccagactccgatctgtgcaaccccatgggcttgcaactcaa

SEQ ID NO: 363 - protein, 320 aa, Mus sp.
PFLFNHLHGLGLTRLRTLDLSSNWLKHISIPELAALPTYLKNRLYLHNNPLPCDCSLYHLLRRWHQRGLSALHDFEREYTCLVFKVSESRVRFFEHSRVFKNCSVAAAPGLELPEEQLHAQVGQSLRLFCNTSVPATRVAWVSPKNELLVAPASQDGSIAVLADGSLAIGRVQEQHAGVFVCLASGPRLHHNQTLEYNVSVQKARPEPETFNTGFTTLLGCIVGLVLVLLYLFAPPCRGCCHCCQRACRNRCWPRASSPLQELSAQSSMLSTTPPDAPSRKASVHKHVVFLEPGKKGLNGRVQLAVPPDSDLCNPMGLQL

SEQ ID NO: 364 - protein, 16 aa, Mus sp.
PFLFNHLHGLGLTRLR

SEQ ID NO: 365 - protein, 304 aa, Mus sp.
TLDLSSNWLKHISIPELAALPTYLKNRLYLHNNPLPCDCSLYHLLRRWHQRGLSALHDFEREYTCLVFKVSESRVRFFEHSRVFKNCSVAAAPGLELPEEQLHAQVGQSLRLFCNTSVPATRVAWVSPKNELLVAPASQDGSIAVLADGSLAIGRVQEQHAGVFVCLASGPRLHHNQTLEYNVSVQKARPEPETFNTGFTTLLGCIVGLVLVLLYLFAPPCRGCCHCCQRACRNRCWPRASSPLQELSAQSSMLSTTPPDAPSRKASVHKHVVFLEPGKKGLNGRVQLAVPPDSDLCNPMGLQL

SEQ ID NO: 366 - protein, 197 aa, Mus sp.
TLDLSSNWLKHISIPELAALPTYLKNRLYLHNNPLPCDCSLYHLLRRWHQRGLSALHDFEREYTCLVFKVSESRVRFFEHSRVFKNCSVAAAPGLELPEEQLHAQVGQSLRLFCNTSVPATRVAWVSPKNELLVAPASQDGSIAVLADGSLAIGRVQEQHAGVFVCLASGPRLHHNQTLEYNVSVQKARPEPETFNT

SEQ ID NO: 367 - protein, 20 aa, Mus sp.
GFTTLLGCIVGLVLVLLYLF

SEQ ID NO: 368 - protein, 87 aa, Mus sp.
APPCRGCCHCCQRACRNRCWPRASSPLQELSAQSSMLSTTPPDAPSRKASVHKHVVFLEPGKKGLNGRVQLAVPPDSDLCNPMGLQL

SEQ ID NO: 369 - DNA, 24 bp, Artificial Sequence
  PCR primer
attattcagaaggatgtcccgtgg

SEQ ID NO: 370 - DNA, 23 bp, Artificial Sequence
  PCR primer
cctcctgattacctacaatggtc

SEQ ID NO: 371 - DNA, 1656 bp, Homo sapiens
gtcgacccacgcgtccgcccacgcgtccggcccatggcgccgcccgccgcccgcctcgccctgctctccgccgcggcgctcacgctggcggcccggcccgcgcctagccccggcctcggccccggacccgagtgtttcacagccaatggtgcggattataggggaacacagaactggacagcactacaaggcgggaagccatgtctgttttggaacgagactttccagcatccatacaacactctgaaataccccaacggggaggggggcctgggtgagcacaactattgcagaaatccagatggagacgtgagcccctggtgctatgtggcagagcacgaggatggtgtctactggaagtactgtgagatacctgcttgccagatgcctggaaaccttggctgctacaaggatcatggaaacccacctcctctaactggcaccagtaaaacgtccaacaaactcaccatacaaacttgcatcagtttttgtcggagtcagaggttcaagtttgctgggatggagtcaggctatgcttgcttctgtggaaacaatcctgattactggaagtacggggaggcagccagtaccgaatgcaacagcgtctgcttcggggatcacacccaaccctgtggtggcgatggcaggatcatcctctttgatactctcgtgggcgcctgcggtgggaactactcagccatgtcttctgtggtctattcccctgacttccccgacacctatgccacggggagggtctgctactggaccatccgggttccgggggcctcccacatccacttcagcttccccctatttgacatcagggactcggcggacatggtggagcttctggatggctacacccaccgtgtcctagcccgcttccacgggaggagccgcccacctctgtccttcaacgtctctctggacttcgtcatcttgtatttcttctctgatcgcatcaatcaggcccagggatttgctgttttataccaagccgtcaaggaagaactgccacaggagaggcccgctgtcaaccagacggtggccgaggtgatcacggagcaggccaacctcagtgtcagcgctgcccggtcctccaaagtcctctatgtcatcaccaccagccccagccacccacctcagactgtcccaggtagcaattcctgggcgccacccatgggggctggaagccacagagttgaaggatggacagtctatggtctggcaactctcctcatcctcacagtcacagccattgtagcaaagatacttctgcacgtcacattcaaatcccatcgtgttcctgcttcaggggaccttagggattgtcatcaaccagggacttcgggggaaatctggagcattttttacaagccttccacttcaatttccatctttaagaagaaactcaagggtcagagtcaacaagatgaccgcaatccccttgtgagtgactaaaaaccccactgtgcctaggacttgaggtccctctttgagctcaaggctgccgtggtcaacctctcctgtggttcttctctgacagactcttccctcctctccctctgcctcggcctcttcggggaaaccctcctcctacagactaggaagaggcacctgctgccagggcaggcagagcctggattcctcctgctt

SEQ ID NO: 372 - DNA, 1425 bp, Homo sapiens
atggcgccgcccgccgcccgcctcgccctgctctccgccgcggcgctcacgctggcggcccggcccgcgcctagccccggcctcggccccggacccgagtgtttcacagccaatggtgcggattataggggaacacagaactggacagcactacaaggcgggaagccatgtctgttttggaacgagactttccagcatccatacaacactctgaaataccccaacggggaggggggcctgggtgagcacaactattgcagaaatccagatggagacgtgagcccctggtgctatgtggcagagcacgaggatggtgtctactggaagtactgtgagatacctgcttgccagatgcctggaaaccttggctgctacaaggatcatggaaacccacctcctctaactggcaccagtaaaacgtccaacaaactcaccatacaaacttgcatcagtttttgtcggagtcagaggttcaagtttgctgggatggagtcaggctatgcttgcttctgtggaaacaatcctgattactggaagtacggggaggcagccagtaccgaatgcaacagcgtctgcttcggggatcacacccaaccctgtggtggcgatggcaggatcatcctctttgatactctcgtgggcgcctgcggtgggaactactcagccatgtcttctgtggtctattcccctgacttccccgacacctatgccacggggagggtctgctactggaccatccgggttccgggggcctcccacatccacttcagcttccccctatttgacatcagggactcggcggacatggtggagcttctggatggctacacccaccgtgtcctagcccgcttccacgggaggagccgcccacctctgtccttcaacgtctctctggacttcgtcatcttgtatttcttctctgatcgcatcaatcaggcccagggatttgctgttttataccaagccgtcaaggaagaactgccacaggagaggcccgctgtcaaccagacggtggccgaggtgatcacggagcaggccaacctcagtgtcagcgctgcccggtcctccaaagtcctctatgtcatcaccaccagccccagccacccacctcagactgtcccaggtagcaattcctgggcgccacccatgggggctggaagccacagagttgaaggatggacagtctatggtctggcaactctcctcatcctcacagtcacagccattgtagcaaagatacttctgcacgtcacattcaaatcccatcgtgttcctgcttcaggggaccttagggattgtcatcaaccagggacttcgggggaaatctggagcattttttacaagccttccacttcaatttccatctttaagaagaaactcaagggtcagagtcaacaagatgaccgcaatccccttgtgagtgac

SEQ ID NO: 373 - protein, 475 aa, Homo sapiens
MAPPAARLALLSAAALTLAARPAPSPGLGPGPECFTANGADYRGTQNWTALQGGKPCLFWNETFQHPYNTLKYPNGEGGLGEHNYCRNPDGDVSPWCYVAEHEDGVYWKYCEIPACQMPGNLGCYKDHGNPPPLTGTSKTSNKLTIQTCISFCRSQRFKFAGMESGYACFCGNNPDYWKYGEAASTECNSVCFGDHTQPCGGDGRIILFDTLVGACGGNYSAMSSVVYSPDFPDTYATGRVCYWTIRVPGASHIHFSFPLFDIRDSADMVELLDGYTHRVLARFHGRSRPPLSFNVSLDFVILYFFSDRINQAQGFAVLYQAVKEELPQERPAVNQTVAEVITEQANLSVSAARSSKVLYVITTSPSHPPQTVPGSNSWAPPMGAGSHRVEGWTVYGLATLLILTVTAIVAKILLHVTFKSHRVPASGDLRDCHQPGTSGEIWSIFYKPSTSISIFKKKLKGQSQQDDRNPLVSD

SEQ ID NO: 374 - protein, 19 aa, Homo sapiens
MAPPAARLALLSAAALTLA

SEQ ID NO: 375 - protein, 456 aa, Homo sapiens
ARPAPSPGLGPGPECFTANGADYRGTQNWTALQGGKPCLFWNETFQHPYNTLKYPNGEGGLGEHNYCRNPDGDVSPWCYVAEHEDGVYWKYCEIPACQMPGNLGCYKDHGNPPPLTGTSKTSNKLTIQTCISFCRSQRFKFAGMESGYACFCGNNPDYWKYGEAASTECNSVCFGDHTQPCGGDGRIILFDTLVGACGGNYSAMSSVVYSPDFPDTYATGRVCYWTIRVPGASHIHFSFPLFDIRDSADMVELLDGYTHRVLARFHGRSRPPLSFNVSLDFVILYFFSDRINQAQGFAVLYQAVKEELPQERPAVNQTVAEVITEQANLSVSAARSSKVLYVITTSPSHPPQTVPGSNSWAPPMGAGSHRVEGWTVYGLATLLILTVTAIVAKILLHVTFKSHRVPASGDLRDCHQPGTSGEIWSIFYKPSTSISIFKKKLKGQSQQDDRNPLVSD

SEQ ID NO: 376 - protein, 373 aa, Homo sapiens
ARPAPSPGLGPGPECFTANGADYRGTQNWTALQGGKPCLFWNETFQHPYNTLKYPNGEGGLGEHNYCRNPDGDVSPWCYVAEHEDGVYWKYCEIPACQMPGNLGCYKDHGNPPPLTGTSKTSNKLTIQTCISFCRSQRFKFAGMESGYACFCGNNPDYWKYGEAASTECNSVCFGDHTQPCGGDGRIILFDTLVGACGGNYSAMSSVVYSPDFPDTYATGRVCYWTIRVPGASHIHFSFPLFDIRDSADMVELLDGYTHRVLARFHGRSRPPLSFNVSLDFVILYFFSDRINQAQGFAVLYQAVKEELPQERPAVNQTVAEVITEQANLSVSAARSSKVLYVITTSPSHPPQTVPGSNSWAPPMGAGSHRVEG

SEQ ID NO: 377 - protein, 23 aa, Homo sapiens
WTVYGLATLLILTVTAIVAKILL

SEQ ID NO: 378 - protein, 60 aa, Homo sapiens
HVTFKSHRVPASGDLRDCHQPGTSGEIWSIFYKPSTSISIFKKKLKGQSQQDDRNPLVSD

SEQ ID NO: 379 - DNA, 4628 bp, Homo sapiens
gcggccgctcgcgatctagaactagtaatgatgctgcctcaaaactcgtggcatattgattttggaagatgctgctgtcatcagaaccttttctctgctgtggtaacttgcatcctgctcctgaattcctgctttctcatcagcagttttaatggaacagatttggagttgaggctggtcaatggagacggtccctgctctgggacagtggaggtgaaattccagggacagtgggggactgtgtgtgatgatgggtggaacactactgcctcaactgtcgtgtgcaaacagcttggatgtccattttctttcgccatgtttcgttttggacaagccgtgactagacatggaaaaatttggcttgatgatgtttcctgttatggaaatgagtcagctctctgggaatgtcaacaccgggaatggggaagccataactgttatcatggagaagatgttggtgtgaactgttatggtgaagccaatctgggtttgaggctagtggatggaaacaactcctgttcagggagagtggaggtgaaattccaagaaaggtgggggactatatgtgatgatgggtggaacttgaatactgctgccgtggtgtgcaggcaactaggatgtccatcttcttttatttcttctggagttgttaatagccctgctgtattgcgccccatttggctggatgacattttatgccaggggaatgagttggcactctggaattgcagacatcgtggatggggaaatcatgactgcagtcacaatgaggatgtcacattaacttgttatgatagtagtgatcttgaactaaggcttgtaggtggaactaaccgctgtatggggagagtagagctgaaaatccaaggaaggtgggggaccgtatgccaccataagtggaacaatgctgcagctgatgtcgtatgcaagcagttgggatgtggaaccgcacttcacttcgctggcttgcctcatttgcagtcagggtctgatgttgtatggcttgatggtgtctcctgctccggtaatgaatcttttctttgggactgcagacattccggaaccgtcaattttgactgtcttcatcaaaacgatgtgtctgtgatctgctcagatggagcagatttggaactgcgactagcagatggaagtaacaattgttcagggagagtagaggtgagaattcatgaacagtggtggacaatatgtgaccagaactggaagaatgaacaagcccttgtggtttgtaagcagctaggatgtccgttcagcgtctttggcagtcgtcgtgctaaacctagtaatgaagctagagacatttggataaacagcatatcttgcactgggaatgagtcagctctctgggactgcacatatgatggaaaagcaaagcgaacatgcttccgaagatcagatgctggagtaatttgttctgataaggcagatctggacctaaggcttgtcggggctcatagcccctgttatgggagattggaggtgaaataccaaggagagtgggggactgtgtgtcatgacagatggagcacaaggaatgcagctgttgtgtgtaaacaattgggatgtggaaagcctatgcatgtgtttggtatgacctattttaaagaagcatcaggacctatttggctggatgacgtttcttgcattggaaatgagtcaaatatctgggactgtgaacacagtggatggggaaagcataattgtgtacacagagaggatgtgattgtaacctgctcaggtgatgcaacatggggcctgaggctggtgggcggcagcaaccgctgctcgggaagactggaggtgtactttcaaggacggtggggcacagtgtgtgatgacggctggaacagtaaagctgcagctgtggtgtgtagccagctggactgcccatcttctatcattggcatgggtctgggaaacgcttctacaggatatggaaaaatttggctcgatgatgtttcctgtgatggagatgagtcagatctctggtcatgcaggaacagtgggtggggaaataatgactgcagtcacagtgaagatgttggagtgatctgttctgatgcatcggatatggagctgaggcttgtgggtggaagcagcaggtgtgctggaaaagttgaggtgaatgtccagggtgccgtgggaattctgtgtgctaatggctggggaatgaacattgctgaagttgtttgcaggcaacttgaatgtgggtctgcaatcagggtctccagagagcctcatttcacagaaagaacattacacatcttaatgtcgaattctggctgcactggaggggaagcctctctctgggattgtatacgatgggagtggaaacagactgcgtgtcatttaaatatggaagcaagtttgatctgctcagcccacaggcagcccaggctggttggagctgatatgccctgctctggacgtgttgaagtgaaacatgcagacacatggcgctctgtctgtgattctgatttctctcttcatgctgccaatgtgctgtgcagagaattaaattgtggagatgccatatctctttctgtgggagatcactttggaaaagggaatggtctaacttgggccgaaaagttccagtgtgaagggagtgaaactcaccttgcattatgccccattgttcaacatccggaagacacttgtatccacagcagagaagttggagttgtctgttcccgatatacagatgtccgacttgtgaatggcaaatcccagtgtgacgggcaagtggagatcaacgtgcttggacactggggctcactgtgtgacacccactgggacccagaagatgcccgtgttctatgcagacagctcagctgtgggactgctctctcaaccacaggaggaaaatatattggagaaagaagtgttcgtgtgtggggacacaggtttcattgcttagggaatgagtcacttctggataactgtcaaatgacagttcttggagcacctccctgtatccatggaaatactgtctctgtgatctgcacaggaagcctgacccagccactgtttccatgcctcgcaaatgtatctgacccatatttgtctgcagttccagagggcagtgctttgatctgcttagaggacaaacggctccgcctagtggatggggacagccgctgtgccgggagagtagagatctatcacgacggcttctggggcaccatctgtgatgacggctgggacctgagcgatgcccacgtggtgtgtcaaaagctgggctgtggagtggccttcaatgccacggtctctgctcactttggggaggggtcagggcccatctggctggatgacctgaactgcacaggaacggagtcccacttgtggcagtgcccttcccgcggctgggggcagcacgactgcaggcacaaggaggacgcaggggtcatctgctcagaattcacagccttgaggctctacagtgaaactgaaacagagagctgtgctgggagattggaagtcttctataacgggacctggggcagcgtcggcaggaggaacatcaccacagccatagcaggcattgtgtgcaggcagctgggctgtggggagaatggagttgtcagcctcgcccctttatctaagacaggctctggtttcatgtgggtggatgacattcagtgtcctaaaacgcatatctccatatggcagtgcctgtctgccccatgggagcgaagaatctccagcccagcagaagagacctggatcacatgtgaagatagaataagagtgcgtggaggagacaccgagtgctctgggagagtggagatctggcacgcaggctcctggggcacagtgtgtgatgactcctgggacctggccgaggcggaagtggtgtgtcagcagctgggctgtggctctgctctggctgccctgagggacgcttcgtttggccagggaactggaaccatctggttggatgacatgcggtgcaaaggaaatgagtcatttctatgggactgtcacgccaaaccctggggacagagtgactgtggacacaaggaagatgctggcgtgaggtgctctggacagtcgctgaaatcactgaatgcctcctcaggtcatttagcacttattttatccagtatctttgggctccttctcctggttctgtttattctatttctcacgtggtgccgagttcagaaacaaaaacatctgcccctcagagtttcaaccagaaggaggggttctctcgaggagaatttattccatgagatggagacctgcctcaagagagaggacccacatgggacaagaacctcagatgacacccccaaccatggttgtgaagatgctagcgacacatcgctgttgggagttcttcctgcctctgaagccacaaaatgactttagacttccagggctcaccagatcaacctctaaatatctttgaaggagacaacaacttttaaatgaataaagaggaagtcaagttgccctatggaaaacttgtccaaataacatttcttgaacaataggagaacagctaaattgataaagactggtgataataaaaattgaattatgtatatcactgttaaaaaaaaaaaaaaaaaaaaaaaaaaaaaacggacgcgtgggtcgac

SEQ ID NO: 380 - DNA, 4359 bp, Homo sapiens
atgatgctgcctcaaaactcgtggcatattgattttggaagatgctgctgtcatcagaaccttttctctgctgtggtaacttgcatcctgctcctgaattcctgctttctcatcagcagttttaatggaacagatttggagttgaggctggtcaatggagacggtccctgctctgggacagtggaggtgaaattccagggacagtgggggactgtgtgtgatgatgggtggaacactactgcctcaactgtcgtgtgcaaacagcttggatgtccattttctttcgccatgtttcgttttggacaagccgtgactagacatggaaaaatttggcttgatgatgtttcctgttatggaaatgagtcagctctctgggaatgtcaacaccgggaatggggaagccataactgttatcatggagaagatgttggtgtgaactgttatggtgaagccaatctgggtttgaggctagtggatggaaacaactcctgttcagggagagtggaggtgaaattccaagaaaggtgggggactatatgtgatgatgggtggaacttgaatactgctgccgtggtgtgcaggcaactaggatgtccatcttcttttatttcttctggagttgttaatagccctgctgtattgcgccccatttggctggatgacattttatgccaggggaatgagttggcactctggaattgcagacatcgtggatggggaaatcatgactgcagtcacaatgaggatgtcacattaacttgttatgatagtagtgatcttgaactaaggcttgtaggtggaactaaccgctgtatggggagagtagagctgaaaatccaaggaaggtgggggaccgtatgccaccataagtggaacaatgctgcagctgatgtcgtatgcaagcagttgggatgtggaaccgcacttcacttcgctggcttgcctcatttgcagtcagggtctgatgttgtatggcttgatggtgtctcctgctccggtaatgaatcttttctttgggactgcagacattccggaaccgtcaattttgactgtcttcatcaaaacgatgtgtctgtgatctgctcagatggagcagatttggaactgcgactagcagatggaagtaacaattgttcagggagagtagaggtgagaattcatgaacagtggtggacaatatgtgaccagaactggaagaatgaacaagcccttgtggtttgtaagcagctaggatgtccgttcagcgtctttggcagtcgtcgtgctaaacctagtaatgaagctagagacatttggataaacagcatatcttgcactgggaatgagtcagctctctgggactgcacatatgatggaaaagcaaagcgaacatgcttccgaagatcagatgctggagtaatttgttctgataaggcagatctggacctaaggcttgtcggggctcatagcccctgttatgggagattggaggtgaaataccaaggagagtgggggactgtgtgtcatgacagatggagcacaaggaatgcagctgttgtgtgtaaacaattgggatgtggaaagcctatgcatgtgtttggtatgacctattttaaagaagcatcaggacctatttggctggatgacgtttcttgcattggaaatgagtcaaatatctgggactgtgaacacagtggatggggaaagcataattgtgtacacagagaggatgtgattgtaacctgctcaggtgatgcaacatggggcctgaggctggtgggcggcagcaaccgctgctcgggaagactggaggtgtactttcaaggacggtggggcacagtgtgtgatgacggctggaacagtaaagctgcagctgtggtgtgtagccagctggactgcccatcttctatcattggcatgggtctgggaaacgcttctacaggatatggaaaaatttggctcgatgatgtttcctgtgatggagatgagtcagatctctggtcatgcaggaacagtgggtggggaaataatgactgcagtcacagtgaagatgttggagtgatctgttctgatgcatcggatatggagctgaggcttgtgggtggaagcagcaggtgtgctggaaaagttgaggtgaatgtccagggtgccgtgggaattctgtgtgctaatggctggggaatgaacattgctgaagttgtttgcaggcaacttgaatgtgggtctgcaatcagggtctccagagagcctcatttcacagaaagaacattacacatcttaatgtcgaattctggctgcactggaggggaagcctctctctgggattgtatacgatgggagtggaaacagactgcgtgtcatttaaatatggaagcaagtttgatctgctcagcccacaggcagcccaggctggttggagctgatatgccctgctctggacgtgttgaagtgaaacatgcagacacatggcgctctgtctgtgattctgatttctctcttcatgctgccaatgtgctgtgcagagaattaaattgtggagatgccatatctctttctgtgggagatcactttggaaaagggaatggtctaacttgggccgaaaagttccagtgtgaagggagtgaaactcaccttgcattatgccccattgttcaacatccggaagacacttgtatccacagcagagaagttggagttgtctgttcccgatatacagatgtccgacttgtgaatggcaaatcccagtgtgacgggcaagtggagatcaacgtgcttggacactggggctcactgtgtgacacccactgggacccagaagatgcccgtgttctatgcagacagctcagctgtgggactgctctctcaaccacaggaggaaaatatattggagaaagaagtgttcgtgtgtggggacacaggtttcattgcttagggaatgagtcacttctggataactgtcaaatgacagttcttggagcacctccctgtatccatggaaatactgtctctgtgatctgcacaggaagcctgacccagccactgtttccatgcctcgcaaatgtatctgacccatatttgtctgcagttccagagggcagtgctttgatctgcttagaggacaaacggctccgcctagtggatggggacagccgctgtgccgggagagtagagatctatcacgacggcttctggggcaccatctgtgatgacggctgggacctgagcgatgcccacgtggtgtgtcaaaagctgggctgtggagtggccttcaatgccacggtctctgctcactttggggaggggtcagggcccatctggctggatgacctgaactgcacaggaacggagtcccacttgtggcagtgcccttcccgcggctgggggcagcacgactgcaggcacaaggaggacgcaggggtcatctgctcagaattcacagccttgaggctctacagtgaaactgaaacagagagctgtgctgggagattggaagtcttctataacgggacctggggcagcgtcggcaggaggaacatcaccacagccatagcaggcattgtgtgcaggcagctgggctgtggggagaatggagttgtcagcctcgcccctttatctaagacaggctctggtttcatgtgggtggatgacattcagtgtcctaaaacgcatatctccatatggcagtgcctgtctgccccatgggagcgaagaatctccagcccagcagaagagacctggatcacatgtgaagatagaataagagtgcgtggaggagacaccgagtgctctgggagagtggagatctggcacgcaggctcctggggcacagtgtgtgatgactcctgggacctggccgaggcggaagtggtgtgtcagcagctgggctgtggctctgctctggctgccctgagggacgcttcgtttggccagggaactggaaccatctggttggatgacatgcggtgcaaaggaaatgagtcatttctatgggactgtcacgccaaaccctggggacagagtgactgtggacacaaggaagatgctggcgtgaggtgctctggacagtcgctgaaatcactgaatgcctcctcaggtcatttagcacttattttatccagtatctttgggctccttctcctggttctgtttattctatttctcacgtggtgccgagttcagaaacaaaaacatctgcccctcagagtttcaaccagaaggaggggttctctcgaggagaatttattccatgagatggagacctgcctcaagagagaggacccacatgggacaagaacctcagatgacacccccaaccatggttgtgaagatgctagcgacacatcgctgttgggagttcttcctgcctctgaagccacaaaa

SEQ ID NO: 381 - protein, 1453 aa, Homo sapiens
MMLPQNSWHIDFGRCCCHQNLFSAVVTCILLLNSCFLISSFNGTDLELRLVNGDGPCSGTVEVKFQGQWGTVCDDGWNTTASTVVCKQLGCPFSFAMFRFGQAVTRHGKIWLDDVSCYGNESALWECQHREWGSHNCYHGEDVGVNCYGEANLGLRLVDGNNSCSGRVEVKFQERWGTICDDGWNLNTAAVVCRQLGCPSSFISSGVVNSPAVLRPIWLDDILCQGNELALWNCRHRGWGNHDCSHNEDVTLTCYDSSDLELRLVGGTNRCMGRVELKIQGRWGTVCHHKWNNAAADVVCKQLGCGTALHFAGLPHLQSGSDVVWLDGVSCSGNESFLWDCRHSGTVNFDCLHQNDVSVICSDGADLELRLADGSNNCSGRVEVRIHEQWWTICDQNWKNEQALVVCKQLGCPFSVFGSRRAKPSNEARDIWINSISCTGNESALWDCTYDGKAKRTCFRRSDAGVICSDKADLDLRLVGAHSPCYGRLEVKYQGEWGTVCHDRWSTRNAAVVCKQLGCGKPMHVFGMTYFKEASGPIWLDDVSCIGNESNIWDCEHSGWGKHNCVHREDVIVTCSGDATWGLRLVGGSNRCSGRLEVYFQGRWGTVCDDGWNSKAAAVVCSQLDCPSSIIGMGLGNASTGYGKIWLDDVSCDGDESDLWSCRNSGWGNNDCSHSEDVGVICSDASDMELRLVGGSSRCAGKVEVNVQGAVGILCANGWGMNIAEVVCRQLECGSAIRVSREPHFTERTLHILMSNSGCTGGEASLWDCIRWEWKQTACHLNMEASLICSAHRQPRLVGADMPCSGRVEVKHADTWRSVCDSDFSLHAANVLCRELNCGDAISLSVGDHFGKGNGLTWAEKFQCEGSETHLALCPIVQHPEDTCIHSREVGVVCSRYTDVRLVNGKSQCDGQVEINVLGHWGSLCDTHWDPEDARVLCRQLSCGTALSTTGGKYIGERSVRVWGHRFHCLGNESLLDNCQMTVLGAPPCIHGNTVSVICTGSLTQPLFPCLANVSDPYLSAVPEGSALICLEDKRLRLVDGDSRCAGRVEIYHDGFWGTICDDGWDLSDAHVVCQKLGCGVAFNATVSAHFGEGSGPIWLDDLNCTGTESHLWQCPSRGWGQHDCRHKEDAGVICSEFTALRLYSETETESCAGRLEVFYNGTWGSVGRRNITTAIAGIVCRQLGCGENGVVSLAPLSKTGSGFMWVDDIQCPKTHISIWQCLSAPWERRISSPAEETWITCEDRIRVRGGDTECSGRVEIWHAGSWGTVCDDSWDLAEAEVVCQQLGCGSALAALRDASFGQGTGTIWLDDMRCKGNESFLWDCHAKPWGQSDCGHKEDAGVRCSGQSLKSLNASSGHLALILSSIFGLLLLVLFILFLTWCRVQKQKHLPLRVSTRRRGSLEENLFHEMETCLKREDPHGTRTSDDTPNHGCEDASDTSLLGVLPASEATK

SEQ ID NO: 382 - protein, 40 aa, Homo sapiens
MMLPQNSWHIDFGRCCCHQNLFSAVVTCILLLNSCFLISS

SEQ ID NO: 383 - protein, 1413 aa, Homo sapiens
FNGTDLELRLVNGDGPCSGTVEVKFQGQWGTVCDDGWNTTASTVVCKQLGCPFSFAMFRFGQAVTRHGKIWLDDVSCYGNESALWECQHREWGSHNCYHGEDVGVNCYGEANLGLRLVDGNNSCSGRVEVKFQERWGTICDDGWNLNTAAVVCRQLGCPSSFISSGVVNSPAVLRPIWLDDILCQGNELALWNCRHRGWGNHDCSHNEDVTLTCYDSSDLELRLVGGTNRCMGRVELKIQGRWGTVCHHKWNNAAADVVCKQLGCGTALHFAGLPHLQSGSDVVWLDGVSCSGNESFLWDCRHSGTVNFDCLHQNDVSVICSDGADLELRLADGSNNCSGRVEVRIHEQWWTICDQNWKNEQALVVCKQLGCPFSVFGSRRAKPSNEARDIWINSISCTGNESALWDCTYDGKAKRTCFRRSDAGVICSDKADLDLRLVGAHSPCYGRLEVKYQGEWGTVCHDRWSTRNAAVVCKQLGCGKPMHVFGMTYFKEASGPIWLDDVSCIGNESNIWDCEHSGWGKHNCVHREDVIVTCSGDATWGLRLVGGSNRCSGRLEVYFQGRWGTVCDDGWNSKAAAVVCSQLDCPSSIIGMGLGNASTGYGKIWLDDVSCDGDESDLWSCRNSGWGNNDCSHSEDVGVICSDASDMELRLVGGSSRCAGKVEVNVQGAVGILCANGWGMNIAEVVCRQLECGSAIRVSREPHFTERTLHILMSNSGCTGGEASLWDCIRWEWKQTACHLNMEASLICSAHRQPRLVGADMPCSGRVEVKHADTWRSVCDSDFSLHAANVLCRELNCGDAISLSVGDHFGKGNGLTWAEKFQCEGSETHLALCPIVQHPEDTCIHSREVGVVCSRYTDVRLVNGKSQCDGQVEINVLGHWGSLCDTHWDPEDARVLCRQLSCGTALSTTGGKYIGERSVRVWGHRFHCLGNESLLDNCQMTVLGAPPCIHGNTVSVICTGSLTQPLFPCLANVSDPYLSAVPEGSALICLEDKRLRLVDGDSRCAGRVEIYHDGFWGTICDDGWDLSDAHVVCQKLGCGVAFNATVSAHFGEGSGPIWLDDLNCTGTESHLWQCPSRGWGQHDCRHKEDAGVICSEFTALRLYSETETESCAGRLEVFYNGTWGSVGRRNITTAIAGIVCRQLGCGENGVVSLAPLSKTGSGFMWVDDIQCPKTHISIWQCLSAPWERRISSPAEETWITCEDRIRVRGGDTECSGRVEIWHAGSWGTVCDDSWDLAEAEVVCQQLGCGSALAALRDASFGQGTGTIWLDDMRCKGNESFLWDCHAKPWGQSDCGHKEDAGVRCSGQSLKSLNASSGHLALILSSIFGLLLLVLFILFLTWCRVQKQKHLPLRVSTRRRGSLEENLFHEMETCLKREDPHGTRTSDDTPNHGCEDASDTSLLGVLPASEATK

SEQ ID NO: 384 - protein, 1319 aa, Homo sapiens
FNGTDLELRLVNGDGPCSGTVEVKFQGQWGTVCDDGWNTTASTVVCKQLGCPFSFAMFRFGQAVTRHGKIWLDDVSCYGNESALWECQHREWGSHNCYHGEDVGVNCYGEANLGLRLVDGNNSCSGRVEVKFQERWGTICDDGWNLNTAAVVCRQLGCPSSFISSGVVNSPAVLRPIWLDDILCQGNELALWNCRHRGWGNHDCSHNEDVTLTCYDSSDLELRLVGGTNRCMGRVELKIQGRWGTVCHHKWNNAAADVVCKQLGCGTALHFAGLPHLQSGSDVVWLDGVSCSGNESFLWDCRHSGTVNFDCLHQNDVSVICSDGADLELRLADGSNNCSGRVEVRIHEQWWTICDQNWKNEQALVVCKQLGCPFSVFGSRRAKPSNEARDIWINSISCTGNESALWDCTYDGKAKRTCFRRSDAGVICSDKADLDLRLVGAHSPCYGRLEVKYQGEWGTVCHDRWSTRNAAVVCKQLGCGKPMHVFGMTYFKEASGPIWLDDVSCIGNESNIWDCEHSGWGKHNCVHREDVIVTCSGDATWGLRLVGGSNRCSGRLEVYFQGRWGTVCDDGWNSKAAAVVCSQLDCPSSIIGMGLGNASTGYGKIWLDDVSCDGDESDLWSCRNSGWGNNDCSHSEDVGVICSDASDMELRLVGGSSRCAGKVEVNVQGAVGILCANGWGMNIAEVVCRQLECGSAIRVSREPHFTERTLHILMSNSGCTGGEASLWDCIRWEWKQTACHLNMEASLICSAHRQPRLVGADMPCSGRVEVKHADTWRSVCDSDFSLHAANVLCRELNCGDAISLSVGDHFGKGNGLTWAEKFQCEGSETHLALCPIVQHPEDTCIHSREVGVVCSRYTDVRLVNGKSQCDGQVEINVLGHWGSLCDTHWDPEDARVLCRQLSCGTALSTTGGKYIGERSVRVWGHRFHCLGNESLLDNCQMTVLGAPPCIHGNTVSVICTGSLTQPLFPCLANVSDPYLSAVPEGSALICLEDKRLRLVDGDSRCAGRVEIYHDGFWGTICDDGWDLSDAHVVCQKLGCGVAFNATVSAHFGEGSGPIWLDDLNCTGTESHLWQCPSRGWGQHDCRHKEDAGVICSEFTALRLYSETETESCAGRLEVFYNGTWGSVGRRNITTAIAGIVCRQLGCGENGVVSLAPLSKTGSGFMWVDDIQCPKTHISIWQCLSAPWERRISSPAEETWITCEDRIRVRGGDTECSGRVEIWHAGSWGTVCDDSWDLAEAEVVCQQLGCGSALAALRDASFGQGTGTIWLDDMRCKGNESFLWDCHAKPWGQSDCGHKEDAGVRCSGQSLKSLNASSGH

SEQ ID NO: 385 - protein, 24 aa, Homo sapiens
LALILSSIFGLLLLVLFILFLTWC

SEQ ID NO: 386 - protein, 70 aa, Homo sapiens
RVQKQKHLPLRVSTRRRGSLEENLFHEMETCLKREDPHGTRTSDDTPNHGCEDASDTSLLGVLPASEATK

SEQ ID NO: 387 - DNA, 3104 bp, Homo sapiens
gtcgacccacgcgtccggtctgtggctgagcatggccctcccagccctgggcctggacccctggagcctcctgggccttttcctcttccaactgcttcagctgctgctgccgacgacgaccgcggggggaggcgggcaggggcccatgcccagggtcagatactatgcaggggatgaacgtagggcacttagcttcttccaccagaagggcctccaggattttgacactctgctcctgagtggtgatggaaatactctctacgtgggggctcgagaagccattctggccttggatatccaggatccaggggtccccaggctaaagaacatgataccgtggccagccagtgacagaaaaaagagtgaatgtgcctttaagaagaagagcaatgagacacagtgtttcaacttcatccgtgtcctggtttcttacaatgtcacccatctctacacctgcggcaccttcgccttcagccctgcttgtaccttcattgaacttcaagattcctacctgttgcccatctcggaggacaaggtcatggagggaaaaggccaaagcccctttgaccccgctcacaagcatacggctgtcttggtggatgggatgctctattctggtactatgaacaacttcctgggcagtgagcccatcctgatgcgcacactgggatcccagcctgtcctcaagaccgacaacttcctccgctggctgcatcatgacgcctcctttgtggcagccatcccttcgacccaggtcgtctacttcttcttcgaggagacagccagcgagtttgacttctttgagaggctccacacatcgcgggtggctagagtctgcaagaatgacgtgggcggcgaaaagctgctgcagaagaagtggaccaccttcctgaaggcccagctgctctgcacccagccggggcagctgcccttcaacgtcatccgccacgcggtcctgctccccgccgattctcccacagctccccacatctacgcagtcttcacctcccagtggcaggttggcgggaccaggagctctgcggtttgtgccttctctctcttggacattgaacgtgtctttaaggggaaatacaaagagttgaacaaagaaacttcacgctggactacttataggggccctgagaccaacccccggccaggcagttgctcagtgggcccctcctctgataaggccctgaccttcatgaaggaccatttcctgatggatgagcaagtggtggggacgcccctgctggtgaaatctggcgtggagtatacacggcttgcagtggagacagcccagggccttgatgggcacagccatcttgtcatgtacctgggaaccaccacagggtcgctccacaaggctgtggtaagtggggacagcagtgctcatctggtggaagagattcagctgttccctgaccctgaacctgttcgcaacctgcagctggcccccacccagggtgcagtgtttgtaggcttctcaggaggtgtctggagggtgccccgagccaactgtagtgtctatgagagctgtgtggactgtgtccttgcccgggacccccactgtgcctgggaccctgagtcccgaacctgttgcctcctgtctgcccccaacctgaactcctggaagcaggacatggagcgggggaacccagagtgggcatgtgccagtggccccatgagcaggagccttcggcctcagagccgcccgcaaatcattaaagaagtcctggctgtccccaactccatcctggagctcccctgcccccacctgtcagccttggcctcttattattggagtcatggcccagcagcagtcccagaagcctcttccactgtctacaatggctccctcttgctgatagtgcaggatggagttgggggtctctaccagtgctgggcaactgagaatggcttttcataccctgtgatctcctactgggtggacagccaggaccagaccctggccctggatcctgaactggcaggcatcccccgggagcatgtgaaggtcccgttgaccagggtcagtggtggggccgccctggctgcccagcagtcctactggccccactttgtcactgtcactgtcctctttgccttagtgctttcaggagccctcatcatcctcgtggcctccccattgagagcactccgggctcggggcaaggttcagggctgtgagaccctgcgccctggggagaaggccccgttaagcagagagcaacacctccagtctcccaaggaatgcaggacctctgccagtgatgtggacgctgacaacaactgcctaggcactgaggtagcttaaactctaggcacaggccggggctgcggtgcaggcacctggccatgctggctgggcggcccaagcacagccctgactaggatgacagcagcacaaaagaccacctttctcccctgagaggagcttctgctactctgcatcactgatgacactcagcagggtgatgcacagcagtctgcctcccctatgggactcccttctaccaagcacatgagctctctaacagggtgggggctacccccagacctgctcctacactgatattgaagaacctggagaggatccttcagttctggccattccagggaccctccagaaacacagtgtttcaagagatcctaaaaaaacctgcctgtcccaggaccctatggtaatgaacaccaaacatctaaacaatcatatgctaacatgccactcctggaaactccactctgaagctgccgctttggacaccaacactcccttctcccagggtcatgcagggatctgctccctcctgcttcccttaccagtcgtgcaccgctgactcccaggaagtctttcctgaagtctgaccacctttcttcttgcttcagttggggcagactctgatcccttctgccctggcagaatggcaggggtaatctgagccttcttcactcctttaccctagctgaccccttcacctctccccctcccttttcctttgttttgggattcagaaaactgcttgtcagagactgtttattttttattaaaaatataaggcttaaaaaaaaaaaaaaaaaaaaaaaaaaaaaagggcggccgc

SEQ ID NO: 388 - DNA, 2283 bp, Homo sapiens
atggccctcccagccctgggcctggacccctggagcctcctgggccttttcctcttccaactgcttcagctgctgctgccgacgacgaccgcggggggaggcgggcaggggcccatgcccagggtcagatactatgcaggggatgaacgtagggcacttagcttcttccaccagaagggcctccaggattttgacactctgctcctgagtggtgatggaaatactctctacgtgggggctcgagaagccattctggccttggatatccaggatccaggggtccccaggctaaagaacatgataccgtggccagccagtgacagaaaaaagagtgaatgtgcctttaagaagaagagcaatgagacacagtgtttcaacttcatccgtgtcctggtttcttacaatgtcacccatctctacacctgcggcaccttcgccttcagccctgcttgtaccttcattgaacttcaagattcctacctgttgcccatctcggaggacaaggtcatggagggaaaaggccaaagcccctttgaccccgctcacaagcatacggctgtcttggtggatgggatgctctattctggtactatgaacaacttcctgggcagtgagcccatcctgatgcgcacactgggatcccagcctgtcctcaagaccgacaacttcctccgctggctgcatcatgacgcctcctttgtggcagccatcccttcgacccaggtcgtctacttcttcttcgaggagacagccagcgagtttgacttctttgagaggctccacacatcgcgggtggctagagtctgcaagaatgacgtgggcggcgaaaagctgctgcagaagaagtggaccaccttcctgaaggcccagctgctctgcacccagccggggcagctgcccttcaacgtcatccgccacgcggtcctgctccccgccgattctcccacagctccccacatctacgcagtcttcacctcccagtggcaggttggcgggaccaggagctctgcggtttgtgccttctctctcttggacattgaacgtgtctttaaggggaaatacaaagagttgaacaaagaaacttcacgctggactacttataggggccctgagaccaacccccggccaggcagttgctcagtgggcccctcctctgataaggccctgaccttcatgaaggaccatttcctgatggatgagcaagtggtggggacgcccctgctggtgaaatctggcgtggagtatacacggcttgcagtggagacagcccagggccttgatgggcacagccatcttgtcatgtacctgggaaccaccacagggtcgctccacaaggctgtggtaagtggggacagcagtgctcatctggtggaagagattcagctgttccctgaccctgaacctgttcgcaacctgcagctggcccccacccagggtgcagtgtttgtaggcttctcaggaggtgtctggagggtgccccgagccaactgtagtgtctatgagagctgtgtggactgtgtccttgcccgggacccccactgtgcctgggaccctgagtcccgaacctgttgcctcctgtctgcccccaacctgaactcctggaagcaggacatggagcgggggaacccagagtgggcatgtgccagtggccccatgagcaggagccttcggcctcagagccgcccgcaaatcattaaagaagtcctggctgtccccaactccatcctggagctcccctgcccccacctgtcagccttggcctcttattattggagtcatggcccagcagcagtcccagaagcctcttccactgtctacaatggctccctcttgctgatagtgcaggatggagttgggggtctctaccagtgctgggcaactgagaatggcttttcataccctgtgatctcctactgggtggacagccaggaccagaccctggccctggatcctgaactggcaggcatcccccgggagcatgtgaaggtcccgttgaccagggtcagtggtggggccgccctggctgcccagcagtcctactggccccactttgtcactgtcactgtcctctttgccttagtgctttcaggagccctcatcatcctcgtggcctccccattgagagcactccgggctcggggcaaggttcagggctgtgagaccctgcgccctggggagaaggccccgttaagcagagagcaacacctccagtctcccaaggaatgcaggacctctgccagtgatgtggacgctgacaacaactgcctaggcactgaggtagct

SEQ ID NO: 389 - protein, 761 aa, Homo sapiens
MALPALGLDPWSLLGLFLFQLLQLLLPTTTAGGGGQGPMPRVRYYAGDERRALSFFHQKGLQDFDTLLLSGDGNTLYVGAREAILALDIQDPGVPRLKNMIPWPASDRKKSECAFKKKSNETQCFNFIRVLVSYNVTHLYTCGTFAFSPACTFIELQDSYLLPISEDKVMEGKGQSPFDPAHKHTAVLVDGMLYSGTMNNFLGSEPILMRTLGSQPVLKTDNFLRWLHHDASFVAAIPSTQVVYFFFEETASEFDFFERLHTSRVARVCKNDVGGEKLLQKKWTTFLKAQLLCTQPGQLPFNVIRHAVLLPADSPTAPHIYAVFTSQWQVGGTRSSAVCAFSLLDIERVFKGKYKELNKETSRWTTYRGPETNPRPGSCSVGPSSDKALTFMKDHFLMDEQVVGTPLLVKSGVEYTRLAVETAQGLDGHSHLVMYLGTTTGSLHKAVVSGDSSAHLVEEIQLFPDPEPVRNLQLAPTQGAVFVGFSGGVWRVPRANCSVYESCVDCVLARDPHCAWDPESRTCCLLSAPNLNSWKQDMERGNPEWACASGPMSRSLRPQSRPQIIKEVLAVPNSILELPCPHLSALASYYWSHGPAAVPEASSTVYNGSLLLIVQDGVGGLYQCWATENGFSYPVISYWVDSQDQTLALDPELAGIPREHVKVPLTRVSGGAALAAQQSYWPHFVTVTVLFALVLSGALIILVASPLRALRARGKVQGCETLRPGEKAPLSREQHLQSPKECRTSASDVDADNNCLGTEVA

SEQ ID NO: 390 - protein, 31 aa, Homo sapiens
MALPALGLDPWSLLGLFLFQLLQLLLPTTTA

SEQ ID NO: 391 - protein, 730 aa, Homo sapiens
GGGGQGPMPRVRYYAGDERRALSFFHQKGLQDFDTLLLSGDGNTLYVGAREAILALDIQDPGVPRLKNMIPWPASDRKKSECAFKKKSNETQCFNFIRVLVSYNVTHLYTCGTFAFSPACTFIELQDSYLLPISEDKVMEGKGQSPFDPAHKHTAVLVDGMLYSGTMNNFLGSEPILMRTLGSQPVLKTDNFLRWLHHDASFVAAIPSTQVVYFFFEETASEFDFFERLHTSRVARVCKNDVGGEKLLQKKWTTFLKAQLLCTQPGQLPFNVIRHAVLLPADSPTAPHIYAVFTSQWQVGGTRSSAVCAFSLLDIERVFKGKYKELNKETSRWTTYRGPETNPRPGSCSVGPSSDKALTFMKDHFLMDEQVVGTPLLVKSGVEYTRLAVETAQGLDGHSHLVMYLGTTTGSLHKAVVSGDSSAHLVEEIQLFPDPEPVRNLQLAPTQGAVFVGFSGGVWRVPRANCSVYESCVDCVLARDPHCAWDPESRTCCLLSAPNLNSWKQDMERGNPEWACASGPMSRSLRPQSRPQIIKEVLAVPNSILELPCPHLSALASYYWSHGPAAVPEASSTVYNGSLLLIVQDGVGGLYQCWATENGFSYPVISYWVDSQDQTLALDPELAGIPREHVKVPLTRVSGGAALAAQQSYWPHFVTVTVLFALVLSGALIILVASPLRALRARGKVQGCETLRPGEKAPLSREQHLQSPKECRTSASDVDADNNCLGTEVA

SEQ ID NO: 392 - protein, 652 aa, Homo sapiens
GGGGQGPMPRVRYYAGDERRALSFFHQKGLQDFDTLLLSGDGNTLYVGAREAILALDIQDPGVPRLKNMIPWPASDRKKSECAFKKKSNETQCFNFIRVLVSYNVTHLYTCGTFAFSPACTFIELQDSYLLPISEDKVMEGKGQSPFDPAHKHTAVLVDGMLYSGTMNNFLGSEPILMRTLGSQPVLKTDNFLRWLHHDASFVAAIPSTQVVYFFFEETASEFDFFERLHTSRVARVCKNDVGGEKLLQKKWTTFLKAQLLCTQPGQLPFNVIRHAVLLPADSPTAPHIYAVFTSQWQVGGTRSSAVCAFSLLDIERVFKGKYKELNKETSRWTTYRGPETNPRPGSCSVGPSSDKALTFMKDHFLMDEQVVGTPLLVKSGVEYTRLAVETAQGLDGHSHLVMYLGTTTGSLHKAVVSGDSSAHLVEEIQLFPDPEPVRNLQLAPTQGAVFVGFSGGVWRVPRANCSVYESCVDCVLARDPHCAWDPESRTCCLLSAPNLNSWKQDMERGNPEWACASGPMSRSLRPQSRPQIIKEVLAVPNSILELPCPHLSALASYYWSHGPAAVPEASSTVYNGSLLLIVQDGVGGLYQCWATENGFSYPVISYWVDSQDQTLALDPELAGIPREHVKVPLTRVSGGAALAAQQSYWPH

SEQ ID NO: 393 - protein, 21 aa, Homo sapiens
FVTVTVLFALVLSGALIILVA

SEQ ID NO: 394 - protein, 57 aa, Homo sapiens
SPLRALRARGKVQGCETLRPGEKAPLSREQHLQSPKECRTSASDVDADNNCLGTEVA

SEQ ID NO: 395 - skipped
  Unknown

SEQ ID NO: 396 - skipped
  Unknown

SEQ ID NO: 397 - skipped
  Unknown

SEQ ID NO: 398 - skipped
  Unknown

SEQ ID NO: 399 - skipped
  Unknown

SEQ ID NO: 400 - skipped
  Unknown

SEQ ID NO: 401 - skipped
  Unknown

SEQ ID NO: 402 - skipped
  Unknown

SEQ ID NO: 403 - DNA, 1980 bp, Homo sapiens
gtcgacccacgcgtccgcagctttggacacttcctctgcttgaggacaccttgactaacctccaagggcaactaaaggatcaagaaaggcccagcacagcagaagatcagctggatctagctcctgcaggagatgtgtacaaagacaatcccagtcctctggggatgtttcctcctgtggaatctctatgtctcatcctctcagaccatttaccctggaatcaaggcaaggattactcagagggcacttgactatggtgttcaagctggaatgaagatgattgagcaaatgctaaaagaaaagaaactcccagatttaagcggttctgagtctcttgaatttctaaaagttgattatgtaaactacaatttttcaaatataaaaatcagtgccttttcatttccaaatacctcattggcttttgtgcctggagtgggaatcaaagcgctaaccaaccatggcactgccaacatcagcacagactgggggttcgagtctccactttttgttctgtataactcctttgctgagcccatggagaaacccattttaaagaacttaaatgaaatgctctgtcccattattgcaagtgaagtcaaagcgctaaatgccaacctcagcacactggaggttttaaccaagattgacaactacactctgctggattactccctaatcagttctccagaaattactgagaactaccttgacctgaacttgaagggtgtattctacccactggaaaacctcaccgacccccccttctcaccagttccttttgtgctcccagaacgcagcaactccatgctctacattggaatcgccgagtatttctttaaatctgcgtcctttgctcatttcacagctggggttttcaatctcactctctccaccgaagagatttccaaccattttgttcaaaactctcaaggccttggcaacgtgctctcccggattgcagagatctacatcttgtcccagcccttcatggtgaggatcatggccacagagcctcccataatcaatctacaaccaggcaatttcaccctggacatccctgcctccatcatgatgctcacccaacccaagaactccacagttgaaaccatcgtttccatggacttcgttgctagtaccagtgttggcctggttattttgggacaaagactggtctgctccttgtctctgaacagattccgccttgctttgccagagtccaatcgcagcaacattgaggtcttgaggtttgaaaatattctatcgtccattcttcactttggagtcctcccactggccaatgcaaaattgcagcaaggatttcctctgcccaatccacacaaattcttattcgtcaattcagatattgaagttcttgagggtttccttttgatttccaccgacctgaagtatgaaacatcctcaaagcagcagccaagtttccacgtatgggaaggtctgaacctgataagcagacagtggagggggaagtcagccccttgattgccggtttgcaattcaccccaggaagtaaatggtccttaatcctacaactactgtaaacccagaagggaaagacagtacacactggaattgtaaagcccttgtgaattgcttaggcagaaagttttctttcttaagccttcaggaacccagaataaggcagactctgttaaagggataaatagaggtgtctgaatgtgagtgtatgcatgctgcgtgtgtctgtgtttatgtttgtttgtttgtttggggcaagaaagattctaggacaagagctaggcatgtacttctgaccaggtgggtaagcaactctaagtctgtatttgtattggtcattctcagtggaaatcccttaggccctctagtggttttcccctacctgcatattggttttcatgttttatattcactgttactatcttctgtgtttaattaaaattgttttctatcaaaaaaaaaaaaaaaaaaaagggcggccgc

SEQ ID NO: 404 - DNA, 1365 bp, Homo sapiens
atgtgtacaaagacaatcccagtcctctggggatgtttcctcctgtggaatctctatgtctcatcctctcagaccatttaccctggaatcaaggcaaggattactcagagggcacttgactatggtgttcaagctggaatgaagatgattgagcaaatgctaaaagaaaagaaactcccagatttaagcggttctgagtctcttgaatttctaaaagttgattatgtaaactacaatttttcaaatataaaaatcagtgccttttcatttccaaatacctcattggcttttgtgcctggagtgggaatcaaagcgctaaccaaccatggcactgccaacatcagcacagactgggggttcgagtctccactttttgttctgtataactcctttgctgagcccatggagaaacccattttaaagaacttaaatgaaatgctctgtcccattattgcaagtgaagtcaaagcgctaaatgccaacctcagcacactggaggttttaaccaagattgacaactacactctgctggattactccctaatcagttctccagaaattactgagaactaccttgacctgaacttgaagggtgtattctacccactggaaaacctcaccgacccccccttctcaccagttccttttgtgctcccagaacgcagcaactccatgctctacattggaatcgccgagtatttctttaaatctgcgtcctttgctcatttcacagctggggttttcaatctcactctctccaccgaagagatttccaaccattttgttcaaaactctcaaggccttggcaacgtgctctcccggattgcagagatctacatcttgtcccagcccttcatggtgaggatcatggccacagagcctcccataatcaatctacaaccaggcaatttcaccctggacatccctgcctccatcatgatgctcacccaacccaagaactccacagttgaaaccatcgtttccatggacttcgttgctagtaccagtgttggcctggttattttgggacaaagactggtctgctccttgtctctgaacagattccgccttgctttgccagagtccaatcgcagcaacattgaggtcttgaggtttgaaaatattctatcgtccattcttcactttggagtcctcccactggccaatgcaaaattgcagcaaggatttcctctgcccaatccacacaaattcttattcgtcaattcagatattgaagttcttgagggtttccttttgatttccaccgacctgaagtatgaaacatcctcaaagcagcagccaagtttccacgtatgggaaggtctgaacctgataagcagacagtggagggggaagtcagcccct

SEQ ID NO: 405 - protein, 455 aa, Homo sapiens
MCTKTIPVLWGCFLLWNLYVSSSQTIYPGIKARITQRALDYGVQAGMKMIEQMLKEKKLPDLSGSESLEFLKVDYVNYNFSNIKISAFSFPNTSLAFVPGVGIKALTNHGTANISTDWGFESPLFVLYNSFAEPMEKPILKNLNEMLCPIIASEVKALNANLSTLEVLTKIDNYTLLDYSLISSPEITENYLDLNLKGVFYPLENLTDPPFSPVPFVLPERSNSMLYIGIAEYFFKSASFAHFTAGVFNLTLSTEEISNHFVQNSQGLGNVLSRIAEIYILSQPFMVRIMATEPPIINLQPGNFTLDIPASIMMLTQPKNSTVETIVSMDFVASTSVGLVILGQRLVCSLSLNRFRLALPESNRSNIEVLRFENILSSILHFGVLPLANAKLQQGFPLPNPHKFLFVNSDIEVLEGFLLISTDLKYETSSKQQPSFHVWEGLNLISRQWRGKSAP

SEQ ID NO: 406 - protein, 23 aa, Homo sapiens
MCTKTIPVLWGCFLLWNLYVSSS

SEQ ID NO: 407 - protein, 432 aa, Homo sapiens
QTIYPGIKARITQRALDYGVQAGMKMIEQMLKEKKLPDLSGSESLEFLKVDYVNYNFSNIKISAFSFPNTSLAFVPGVGIKALTNHGTANISTDWGFESPLFVLYNSFAEPMEKPILKNLNEMLCPIIASEVKALNANLSTLEVLTKIDNYTLLDYSLISSPEITENYLDLNLKGVFYPLENLTDPPFSPVPFVLPERSNSMLYIGIAEYFFKSASFAHFTAGVFNLTLSTEEISNHFVQNSQGLGNVLSRIAEIYILSQPFMVRIMATEPPIINLQPGNFTLDIPASIMMLTQPKNSTVETIVSMDFVASTSVGLVILGQRLVCSLSLNRFRLALPESNRSNIEVLRFENILSSILHFGVLPLANAKLQQGFPLPNPHKFLFVNSDIEVLEGFLLISTDLKYETSSKQQPSFHVWEGLNLISRQWRGKSAP

SEQ ID NO: 408 - protein, 483 aa, Homo sapiens
MARGPCNAPRWVSLMVLVAIGTAVTAAVNPGVVVRISQKGLDYASQQGTAALQKELKRIKIPDYSDSFKIKHLGKGHYSFYSMDIREFQLPSSQISMVPNVGLKFSISNANIKISGKWKAQKRFLKMSGNFDLSIEGMSISADLKLGSNPTSGKPTITCSSCSSHINSVHVHISKSKVGWLIQLFHKKIESALRNKMNSQVCEKVTNSVSSKLQPYFQTLPVMTKIDSVAGINYGLVAPPATTAETLDVQMKGEFYSENHHNPPPFAPPVMEFPAAHDRMVYLGLSDYFFNTAGLVYQEAGVLKMTLRDDMIPKESKFRLTTKFFGTFLPEVAKKFPNMKIQIHVSASTPPHLSVQPTGLTFYPAVDVQAFAVLPNSSLASLFLIGMHTTGSMEVSAESNRLVGELKLDRLLLELKHSNIGPFPVELLQDIMNYIVPILVLPRVNEKLQKGFPLPTPARVQLYNVVLQPHQNFLLFGADVVYK

SEQ ID NO: 409 - protein, 481 aa, Homo sapiens
MGALARALPSILLALLLTSTPEALGANPGLVARITDKGLQYAAQEGLLALQSELLRITLPDFTGDLRIPHVGRGRYEFHSLNIHEFQLPSSQISMVPNVGLKFSISNANIKISGKWKAQKRFLKMSGNFDLSIEGMSISADLKLGSNPTSGKPTITCSSCSSHINSVHVHISKSKVGWLIQLFHKKIESALRNKMNSQVCEKVTNSVSSKLQPYFQTLPVMTKIDSVAGINYGLVAPPATTAETLDVQMKGEFYSENHHNPPPFAPPVMEFPAAHDRMVYLGLSDYFFNTAGLVYQEAGVLKMTLRDDMIPKESKFRLTTKFFGTFLPEVAKKFPNMKIQIHVSASTPPHLSVQPTGLTFYPAVDVQALAVLPNSSLASLFLIGMHTTGSMEVSAESNRLVGELKLDRLLLELKHSNIGPFPVELLQDIMNYIVPILVLPRVNEKLQKGFPLPTPARVQLYNVVLQPHQNFLLFGADVVYK

SEQ ID NO: 410 - protein, 383 aa, Homo sapiens
MRIAHASSRGNISIFSVFLIPLIAYILILPGVRRKRVVTTVTYVLMLAVGGALIASLIYPCWASGSQMIYTQFRGHSNERILAKIGVEIGLQKVNVTLKFERLLSSNDVLPGSDMTELYYNEGFDISGISSMAEALHHGLENGLPYPMLSVLEYFSLNQDSFDWGRHYRVAGHYTHAAIWFAFACWCLSVVLMLFLPHNAYKSILATGISCLIACLVYLLLSPCELRIAFTGENFERVDLTATFSFCFYLIFAIGILCVLCGLGLGICEHWRIYTLSTFLDASLDEHVGPKWKKLPTGGPALQGVQIGAYGTNTTNSSRDKNDISSDKTAGSSGFQSRTSTCQSSASSASLRSQSSIETVHDEAELERTHVHFLQEPCSSSST

SEQ ID NO: 411 - protein, 399 aa, Homo sapiens
MKMRFLGLVVCLVLWPLHSEGSGGKLTAVDPETNMNVSEIISYWGFPSEEYLVETEDGYILCLNRIPHGRKNHSDKGPKPVVFLQHGLLADSSNWVTNLANSSLGFILADAGFDVWMGNSRGNTWSRKHKTLSVSQDEFWAFSYDEMAKYDLPASINFILNKTGQEQVYYVGHSQGTTIGFIAFSQIPELAKRIKMFFALGPVASVAFCTSPMAKLGRLPDHLIKDLFGDKEFLPQSAFLKWLGTHVCTHVILKELCGNLCFLLCGFNERNLNMSRVDVYTTHSPAGTSVQNMLHWSQAVKFQKFQAFDWGSSAKNYFHYNQSYPPTYNVKDMLVPTAVWSGGHDWLADVYDVNILLTQITNLVFHESIPEWEHLDFIWGLDAPWRLYNKIINLMRKYQ

SEQ ID NO: 412 - protein, 19 aa, Homo sapiens
MAPPAARLALLSAAALTLA

SEQ ID NO: 413 - protein, 451 aa, Homo sapiens
ARPAPGPRSGPECFTANGADYRGTQSWTALQGGKPCLFWNETFQHPYNTLKYPNGEGGLGEHNYCRNPDGDVSPWCYVAEHEDGVYWKYCEIPACQMPGNLGCYKDHGNPPPLTGTSKTSNKLTIQTCISFCRSQRFKFAGMESGYACFCGNNPDYWKHGEAASTECNSVCFGDHTQPCGGDGRIILFDTLVGACGGNYSAMAAVVYSPDFPDTYATGRVCYWTIRVPGASRIHFNFTLFDIRDSADMVELLDGYTHRVLVRLSGRSRPPLSFNVSLDFVILYFFSDRINQAQGFAVLYQATKEEPPQERPAVNQTLAEVITEQANLSVSAAHSSKVLYVITPSPSHPPQTAQVAIPGHRQLGPTATEWKDGLCTAWRPSSSSQSQQLSQRFFCMSHLNLIESLHQETLGTVVSLGLLEISGPFSMNLPLQSPSLRRSSRVRVNKMTAIPS

SEQ ID NO: 414 - protein, 150 aa, Homo sapiens
KKHCWYFEGLYPTYYICRSYEDCCGSRCCVRALSIQRLWYFWFLLMMGVLFCCGAGFFIRRRMYPPPLIEEPTFNVSYTRQPPNPAPGAQQMGPPYYTDPGGPGMNPVGNTMAMAFQVQPNSPHGGTTYPPPPSYCNTPPPPYEQVVKDK

SEQ ID NO: 415 - DNA, 2044 bp, Homo sapiens
gtcgacccacgcgtccggggaattgcagcaggaaaatatgtgaagagtttttaaacccacaaattcttcttactttagaattagttgttacattggcaggaaaaaataaatgcagatgttggaccatgttggaaaccttgtcaagacagtggattgtctcacacagaatggaaatgtggcttctgattctggtggcgtatatgttccagagaaatgtgaattcagtacatatgccaactaaagctgtggacccagaagcattcatgaatattagtgaaatcatccaacatcaaggctatccctgtgaggaatatgaagtcgcaactgaagatgggtatatcctttctgttaacaggattcctcgaggcctagtgcaacctaagaagacaggttccaggcctgtggtgttactgcagcatggcctagttggaggtgctagcaactggatttccaacctgcccaacaatagcctgggcttcattctggcagatgctggttttgacgtgtggatggggaacagcaggggaaacgcctggtctcgaaaacacaagacactctccatagaccaagatgagttctgggctttcagttatgatgagatggctaggtttgaccttcctgcagtgataaactttattttgcagaaaacgggccaggaaaagatctattatgtcggctattcacagggcaccaccatgggctttattgcattttccaccatgccagagctggctcagaaaatcaaaatgtattttgctttagcacccatagccactgttaagcatgcaaaaagccccgggaccaaatttttgttgctgccagatatgatgatcaagggattgtttggcaaaaaagaatttctgtatcagaccagatttctcagacaacttgttatttacctttgtggccaggtgattcttgatcagatttgtagtaatatcatgttacttctgggtggattcaacaccaacaatatgaacatgagccgagcaagtgtatatgctgcccacactcttgctggaacatctgtgcaaaatattctacactggagccaggcagtgaattctggtgaactccgggcatttgactgggggagtgagaccaaaaatctggaaaaatgcaatcagccaactcctgtaaggtacagagtcagagatatgacggtccctacagcaatgtggacaggaggtcaggactggctttcaaatccagaagacgtgaaaatgctgctctctgaggtgaccaacctcatctaccataagaatattcctgaatgggctcacgtggatttcatctggggtttggatgctcctcaccgtatgtacaatgaaatcatccatctgatgcagcaggaggagaccaacctttcccagggacggtgtgaggccgtattgtgaagcatctgacactgacgatcttaggacaacctcctgagggatggggctaggacccatgaaggcagaattacggagagcagagacctagtatacatttttcagattccctgcacttggcactaaatccgacacttacatttacattttttttctgtaaattaaagtacttattaggtaaatagaggttttgtatgctattatatattctaccatcttgaagggtaggttttacctgatagccagaaaatatctagacattctctatatcattcaggtaaatctctttaaaacacctattgttttttctataagccatatttttggagcactaaagtaaaatggcaaattgggacagatattgaggtctggagtctgtggattattgttgactttgacaaaataagctagacattttcaccttgttgccacagagacataacactacctcaggaagctgagctgctttaaggacaacaacaacaaaatcagtgttacagtatggatgaaatctatgttaagcattctcagaataaggccaagttttatagttgcatctcagggaagaaaattttataggatgtttatgagttctccaataaatgcattctgcattacataaaaaaaaaaaaaaaaaaaagggcggccgc

SEQ ID NO: 416 - DNA, 1269 bp, Homo sapiens
atgttggaaaccttgtcaagacagtggattgtctcacacagaatggaaatgtggcttctgattctggtggcgtatatgttccagagaaatgtgaattcagtacatatgccaactaaagctgtggacccagaagcattcatgaatattagtgaaatcatccaacatcaaggctatccctgtgaggaatatgaagtcgcaactgaagatgggtatatcctttctgttaacaggattcctcgaggcctagtgcaacctaagaagacaggttccaggcctgtggtgttactgcagcatggcctagttggaggtgctagcaactggatttccaacctgcccaacaatagcctgggcttcattctggcagatgctggttttgacgtgtggatggggaacagcaggggaaacgcctggtctcgaaaacacaagacactctccatagaccaagatgagttctgggctttcagttatgatgagatggctaggtttgaccttcctgcagtgataaactttattttgcagaaaacgggccaggaaaagatctattatgtcggctattcacagggcaccaccatgggctttattgcattttccaccatgccagagctggctcagaaaatcaaaatgtattttgctttagcacccatagccactgttaagcatgcaaaaagccccgggaccaaatttttgttgctgccagatatgatgatcaagggattgtttggcaaaaaagaatttctgtatcagaccagatttctcagacaacttgttatttacctttgtggccaggtgattcttgatcagatttgtagtaatatcatgttacttctgggtggattcaacaccaacaatatgaacatgagccgagcaagtgtatatgctgcccacactcttgctggaacatctgtgcaaaatattctacactggagccaggcagtgaattctggtgaactccgggcatttgactgggggagtgagaccaaaaatctggaaaaatgcaatcagccaactcctgtaaggtacagagtcagagatatgacggtccctacagcaatgtggacaggaggtcaggactggctttcaaatccagaagacgtgaaaatgctgctctctgaggtgaccaacctcatctaccataagaatattcctgaatgggctcacgtggatttcatctggggtttggatgctcctcaccgtatgtacaatgaaatcatccatctgatgcagcaggaggagaccaacctttcccagggacggtgtgaggccgtattg

SEQ ID NO: 417 - protein, 423 aa, Homo sapiens
MLETLSRQWIVSHRMEMWLLILVAYMFQRNVNSVHMPTKAVDPEAFMNISEIIQHQGYPCEEYEVATEDGYILSVNRIPRGLVQPKKTGSRPVVLLQHGLVGGASNWISNLPNNSLGFILADAGFDVWMGNSRGNAWSRKHKTLSIDQDEFWAFSYDEMARFDLPAVINFILQKTGQEKIYYVGYSQGTTMGFIAFSTMPELAQKIKMYFALAPIATVKHAKSPGTKFLLLPDMMIKGLFGKKEFLYQTRFLRQLVIYLCGQVILDQICSNIMLLLGGFNTNNMNMSRASVYAAHTLAGTSVQNILHWSQAVNSGELRAFDWGSETKNLEKCNQPTPVRYRVRDMTVPTAMWTGGQDWLSNPEDVKMLLSEVTNLIYHKNIPEWAHVDFIWGLDAPHRMYNEIIHLMQQEETNLSQGRCEAVL

SEQ ID NO: 418 - protein, 33 aa, Homo sapiens
MLETLSRQWIVSHRMEMWLLILVAYMFQRNVNS

SEQ ID NO: 419 - protein, 390 aa, Homo sapiens
VHMPTKAVDPEAFMNISEIIQHQGYPCEEYEVATEDGYILSVNRIPRGLVQPKKTGSRPVVLLQHGLVGGASNWISNLPNNSLGFILADAGFDVWMGNSRGNAWSRKHKTLSIDQDEFWAFSYDEMARFDLPAVINFILQKTGQEKIYYVGYSQGTTMGFIAFSTMPELAQKIKMYFALAPIATVKHAKSPGTKFLLLPDMMIKGLFGKKEFLYQTRFLRQLVIYLCGQVILDQICSNIMLLLGGFNTNNMNMSRASVYAAHTLAGTSVQNILHWSQAVNSGELRAFDWGSETKNLEKCNQPTPVRYRVRDMTVPTAMWTGGQDWLSNPEDVKMLLSEVTNLIYHKNIPEWAHVDFIWGLDAPHRMYNEIIHLMQQEETNLSQGRCEAVL

SEQ ID NO: 420 - protein, 221 aa, Homo sapiens
VHMPTKAVDPEAFMNISEIIQHQGYPCEEYEVATEDGYILSVNRIPRGLVQPKKTGSRPVVLLQHGLVGGASNWISNLPNNSLGFILADAGFDVWMGNSRGNAWSRKHKTLSIDQDEFWAFSYDEMARFDLPAVINFILQKTGQEKIYYVGYSQGTTMGFIAFSTMPELAQKIKMYFALAPIATVKHAKSPGTKFLLLPDMMIKGLFGKKEFLYQTRFLRQ

SEQ ID NO: 421 - protein, 25 aa, Homo sapiens
LVIYLCGQVILDQICSNIMLLLGGF

SEQ ID NO: 422 - protein, 144 aa, Homo sapiens
NTNNMNMSRASVYAAHTLAGTSVQNILHWSQAVNSGELRAFDWGSETKNLEKCNQPTPVRYRVRDMTVPTAMWTGGQDWLSNPEDVKMLLSEVTNLIYHKNIPEWAHVDFIWGLDAPHRMYNEIIHLMQQEETNLSQGRCEAVL

SEQ ID NO: 423 - DNA, 2133 bp, Homo sapiens
gtcgacccacgcgtccacggcgagggctcccggggcgcagcattgccccccctgcaccacctcaccaagatggctactttgggacacacattccccttctatgctggccccaagccaaccttcccgatggacaccactttggccagcatcatcatgatctttctgactgcactggccacgttcatcgtcatcctgcctggcattcggggaaagacgaggctgttctggctgcttcgggtggtgaccagcttattcatcggggctgcaatcctggctgtgaatttcagttctgagtggtctgtgggccaggtcagcaccaacacatcatacaaggccttcagttctgagtggatcagcgctgatattgggctgcaggtcgggctgggtggagtcaacatcacactcacagggacccccgtgcagcagctgaatgagaccatcaattacaacgaggagttcacctggcgcctgggtgagaactatgctgaggagtgtgcaaaggctctggagaaggggctgccagaccctgtgttgtacctagctgagaagttcactccaagaagcccatgtggcctataccgccagtaccgcctggcgggacactacacctcagccatgctatgggtggcattcctctgctggctgctggccaatgtgatgctctccatgcctgtgctggtatatggtggctacatgctattggccacgggcatcttccagctgttggctctgctcttcttctccatggccacatcactcacctcaccctgtcccctgcacctgggcgcttctgtgctgcatactcaccatgggcctgccttctggatcacattgaccacaggactgctgtgtgtgctgctgggcctggctatggcggtggcccacaggatgcagcctcacaggctgaaggctttcttcaaccagagtgtggatgaagaccccatgctggagtggagtcctgaggaaggtggactcctgagcccccgctaccggtccatggctgacagtcccaagtcccaggacattcccctgtcagaggcttcctccaccaaggcatactgtaaggaggcacaccccaaagatcctgattgtgctttataacattcctccccgtggaggccacctggacttccagtctggctccaaacctcattggcgccccataaaaccagcagaactgccctcagggtggctgttaccagacacccagcaccaatctacagacggagtagaaaaaggaggctctatatactgatgttaaaaaacaaaacaaaacaaaaagccctaagggactgaagagatgctgggcctgtccataaagcctgttgccatgataaggccaagcaggggctagcttatctgcacagcaacccagcctttccgtgctgccttgcctcttcaagatgctattcactgaaacctaacttcacccccataacaccagcagggtgggggttacatatgattctcctatggtttcctctcatccctcggcacctcttgttttcctttttcctgggttccttttgttcttcctttacttctccagcttgtgtggccttttggtacaatgaaagacagcactggaaaggaggggaaaccaaacttctcatcctaggtctaacattaaccaactatgccacattctctttgagcttcagttcccaaatttgctacataagattgcaagacttgccaagaatcttgggatttatctttctatgccttgctgacacctaccttggccctcaaacaccacctcacaagaagccaggtgggaagttagggaatcaactccaaaacgctattccttcccaccccactcagctgggctagctgagtggcatccaggacgggggagtgggtgacctgcctcatcactgccacctaacgtccccctggggtggttcagaaagatgctagctctggtagggtccctccggcctcactagagggcgcccctattactctggagtcgacgcagagaatcaggtttcacagcactgcggagagtgtactaggctgtctccagcccagcgaagctcatgaggacgtgcgaccccggcgcggagaagccatgaaaattaatgggaaaaacagtttttaaaaaaaaaaaaaaaaaagggcggccgc

SEQ ID NO: 424 - DNA, 1029 bp, Homo sapiens
atggctactttgggacacacattccccttctatgctggccccaagccaaccttcccgatggacaccactttggccagcatcatcatgatctttctgactgcactggccacgttcatcgtcatcctgcctggcattcggggaaagacgaggctgttctggctgcttcgggtggtgaccagcttattcatcggggctgcaatcctggctgtgaatttcagttctgagtggtctgtgggccaggtcagcaccaacacatcatacaaggccttcagttctgagtggatcagcgctgatattgggctgcaggtcgggctgggtggagtcaacatcacactcacagggacccccgtgcagcagctgaatgagaccatcaattacaacgaggagttcacctggcgcctgggtgagaactatgctgaggagtgtgcaaaggctctggagaaggggctgccagaccctgtgttgtacctagctgagaagttcactccaagaagcccatgtggcctataccgccagtaccgcctggcgggacactacacctcagccatgctatgggtggcattcctctgctggctgctggccaatgtgatgctctccatgcctgtgctggtatatggtggctacatgctattggccacgggcatcttccagctgttggctctgctcttcttctccatggccacatcactcacctcaccctgtcccctgcacctgggcgcttctgtgctgcatactcaccatgggcctgccttctggatcacattgaccacaggactgctgtgtgtgctgctgggcctggctatggcggtggcccacaggatgcagcctcacaggctgaaggctttcttcaaccagagtgtggatgaagaccccatgctggagtggagtcctgaggaaggtggactcctgagcccccgctaccggtccatggctgacagtcccaagtcccaggacattcccctgtcagaggcttcctccaccaaggcatactgtaaggaggcacaccccaaagatcctgattgtgcttta

SEQ ID NO: 425 - protein, 343 aa, Homo sapiens
MATLGHTFPFYAGPKPTFPMDTTLASIIMIFLTALATFIVILPGIRGKTRLFWLLRVVTSLFIGAAILAVNFSSEWSVGQVSTNTSYKAFSSEWISADIGLQVGLGGVNITLTGTPVQQLNETINYNEEFTWRLGENYAEECAKALEKGLPDPVLYLAEKFTPRSPCGLYRQYRLAGHYTSAMLWVAFLCWLLANVMLSMPVLVYGGYMLLATGIFQLLALLFFSMATSLTSPCPLHLGASVLHTHHGPAFWITLTTGLLCVLLGLAMAVAHRMQPHRLKAFFNQSVDEDPMLEWSPEEGGLLSPRYRSMADSPKSQDIPLSEASSTKAYCKEAHPKDPDCAL

SEQ ID NO: 426 - protein, 23 aa, Homo sapiens
MATLGHTFPFYAGPKPTFPMDTT

SEQ ID NO: 427 - protein, 112 aa, Homo sapiens
NFSSEWSVGQVSTNTSYKAFSSEWISADIGLQVGLGGVNITLTGTPVQQLNETINYNEEFTWRLGENYAEECAKALEKGLPDPVLYLAEKFTPRSPCGLYRQYRLAGHYTSA

SEQ ID NO: 428 - protein, 22 aa, Homo sapiens
TSLTSPCPLHLGASVLHTHHGP

SEQ ID NO: 429 - protein, 19 aa, Homo sapiens
LASIIMIFLTALATFIVIL

SEQ ID NO: 430 - protein, 20 aa, Homo sapiens
LFWLLRVVTSLFIGAAILAV

SEQ ID NO: 431 - protein, 22 aa, Homo sapiens
MLWVAFLCWLLANVMLSMPVLV

SEQ ID NO: 432 - protein, 17 aa, Homo sapiens
LATGIFQLLALLFFSMA

SEQ ID NO: 433 - protein, 22 aa, Homo sapiens
AFWITLTTGLLCVLLGLAMAVA

SEQ ID NO: 434 - protein, 8 aa, Homo sapiens
PGIRGKTR

SEQ ID NO: 435 - protein, 6 aa, Homo sapiens
YGGYML

SEQ ID NO: 436 - protein, 72 aa, Homo sapiens
HRMQPHRLKAFFNQSVDEDPMLEWSPEEGGLLSPRYRSMADSPKSQDIPLSEASSTKAYCKEAHPKDPDCAL

SEQ ID NO: 437 - DNA, 4928 bp, Mus sp.
gtcgacccacgcgtccgcccggctcccggtgctgccccctctgccccgggccgcgcccgggggtcccgcactgacggcccatggcgccgcccgccgcccgtctcgcgctgctctccgccgctgcgctcactctggcggcccggcccgcgcccggtccccgctccggccccgagtgcttcacagccaacggtgcagattacaggggaacacagagctggacagcgctgcaaggtgggaagccatgtctgttctggaacgagactttccagcatccgtacaacacgctgaagtaccccaacggggaaggaggactgggcgagcacaattattgcagaaatccagatggagacgtgagcccttggtgctacgtggccgagcatgaggacggagtctactggaagtactgtgaaattcctgcctgccagatgcctggaaaccttggctgctacaaggatcatggaaacccacctcctctcacgggcaccagtaaaacctctaacaagctcaccatacaaacctgtatcagcttctgtcggagtcagagattcaagtttgctgggatggagtcaggctatgcctgcttctgtgggaacaatcctgactactggaagcacggggaggcggccagcaccgagtgcaatagtgtctgcttcggggaccacacgcagccctgcggtggggacggcaggattatcctctttgacactctcgtgggcgcctgcggtgggaactactcagccatggcagccgtggtgtactcccctgacttccctgacacctacgccactggcagagtctgctactggaccatccgggttccaggagcctctcgcatccatttcaacttcaccctgtttgatatcagggactctgcagacatggtggagctgctggacggctacacccaccgcgtcctggtccggctcagtgggaggagccgcccgcctctgtctttcaatgtctctctggattttgtcattttgtatttcttctctgatcgcatcaatcaggcccagggatttgctgtgttgtaccaagccaccaaggaggaaccgccacaggagagacctgctgtcaaccagaccctggcagaggtgatcaccgagcaagccaacctcagtgtcagcgctgcccactcctccaaagtcctctatgtcatcacccccagccccagccaccctccgcagactgcccaggtagccattcctgggcaccgtcagttggggccaacagccacagagtggaaggatggactgtgtacggcctggcgaccctcctcatcctcacagtcacagcagttgtcgcaaagattcttctgcatgtcacatttaaatctcatcgagtccctgcatcaggagaccttagggactgtcgtcagcctggggcttctggagatatctggaccattttctatgaaccttccactacaatctccatctttaagaagaagctcaagggtcagagtcaacaagatgaccgcaatcccctcgtgagtgactgaagcccacgcctgcatgagaggctccgctccaagctcgagtttgctcccctgagttctcctctgatgagttccctgccttcccattcaccaccatctcttttgggagcaccctgctttagaggcagcccagcctgggatcctccatcacatgtaccagcctggctgctctgctggggatggtaagacaggcccaggctgacaggacacagctggacctgactccagaagactcttgggtggtggggaggtatagtgtaggatgagttttcttgcttcttctctgttttgtccacatacagatcggtttcccctgtctttacagtttgcaatagagccagactgaaagaactgtcaggttttctaggctggcctggttccccactaagagtggcattggcgccctagaggcccagaggcccagtgtaggcttggagctttctctgctgccaactaccatgtgtcatctagtccgaggggactgagagcagggccacaccagatgtcatctttctagagggttctttttagtacccactgaccaatggggcaagcctgaggattggtccatctgtttgtccatggaacagacacagtgaacttcctggatactagacttaactagcctagccctcaagtagttgccaatcctgtggaatcagaattcagcctgtcttcctgtcctcagcccaagcctgtagcctagagctggggctgtagcctagagctggggctgtagcctagagctggggctgtagcacagagctggggctgtagcctagagctggggctgtagcacagagctggggctgtagcctagagctggggctgtagcacagagctggggctgtagcacagagctggggctgtagcctagagctggggctgtagcacagagctggggctgtaactcagcgatcaagagcttgctttgtatacatcggaccctaggttctatcccagcactatcagaaggtgggagagaaaaagactgcaccatagcatgcgggcagcatctgtggttcctacgtgaggtgtcatcattttaaaagcagatcaaaactaccgcgagttttgtcctttgtcccttatcatgggagcagagtaggagtaagggctctggtcttgctcattgtcccccagacagggaggcaggaaaaggtcaggcttgggaactggagatcctcccaggaaaagctgcaagattgagagacccagctgcagttgggagaggaagggccatccccgactgagaagtcctgcagtctggaagtggcctttgtcagcagcagctgtgccctgaaggtagaccttggtcactctcctgccagcccttgagcctctgctctcctgggtaccctcctggaacaccatgctaaccttccccgagtctctcagtcactgccattgaggcctctcctctagctgctgctccccaggactgtctggggccatctggggatcagggagaggcagcaggagtactgacgaggcagtgacctgagctgatgagtcaaccagaggacaccagagtctacagtgggctggctgctggctcagctcctatgggaggcctacaggggtactaagctagggggtcatcatctcatttgatctgggaaaggctacaggctcctggatgtgaagacaggcccactacataagaagaccactggaaatagactgacaggagcaggttccactctaggctgtccatagcgtttgcaggactcccctgagaccaagtgttgagtcacagagtgccatgtgcgtagtgcataaaggatatgggttcttaaccagggaaggctcatagcaggccaggacattttttcagctcagagcactggccccaggcttcctctaagccaccactcacctgtctcttcctatctcggacacaggaagcaagccccagtgtggtggcagctgcggctcagcattggtgtccccaggaagggcggtggatgtgcccacgctccttttgctgtgggcctggcacagcccaacactgcagggcccaccttctctcttggggggtagggacacataaggaaaactaacccacctccaacaacagcagaggacagtgggaaggaagggctgtaaatcacccaggccagacctccagaaatgacaggcacagtctgttagaacctgtaggcagccagtcacagagggcctttgtgctggtaacaccctgcctggagcataggggtaagccgagggagaagagcagccctcagagacatcagctaaaaacataggtgccctatgtccctcccttcctgtcacactgcttacaaagcagagacagagtaggaaagaggtcttcatcctctcccacatcagcaaggatagggctgcggctgcctaaagtgagcaaggagaacagagctctggacttctctaaatgtgggctctggcttcagactcctcagccaaaagctcttgaagatcaaagctctggcgggtacagctgtcctggcctgtgggccagcccatgggatgtgcctgggccaggtgccaccccacggctcactgtcatcccaggagggaccccacctgatgctcctcatcatccgctggcctgacactatcagagctcgcgccggctgttgccagggacagactgactacacttgaccttcaagagcacttagaagtggatggcctccagactctgtcagcctctgcaggggccacacaagtctcccgagccaagtccacaagcctccatggttccctggctcctctcctgtggagtgtcctgtttgatgtctgaggtctgctttgggtaccgccctgggaactgctaacctccgattggtccctttgtgtctctgtttactgtcctcttctacctccaggtcacttagctctggctgctctggctgggagtggggggtggggatgctggctgcacccccaccctggtctgccaacagaacctgggggcctcacacgggctcctgtcttgccaagctggagctgagcacactggcccaggctgagtggggcagagcaaacaagtggaaggggatctctctccttagagggaggtggccgaaggtgtagatccagcgagggagctgccatccccgccaccttcatagcagcaagaccttcccatttccaatctcaccctccagcagggatatgactttggacaacaaggctttatttgtaaatatgctcttaatatgcaactttgagaataagatagaaacatcatgtattttaaaatataaaatgaagtgtgacacactgtatacaatttaatatatatttttaggattttgttatttaagaaaatggaatgtgatggtacttaacttttacaaaagagagaaaatgttatttttactgtttgaagaaaataaatattctcattgttgtagaaaaaaaaaaaaaaaaaaagggcggccgc

SEQ ID NO: 438 - DNA, 1410 bp, Mus sp.
atggcgccgcccgccgcccgtctcgcgctgctctccgccgctgcgctcactctggcggcccggcccgcgcccggtccccgctccggccccgagtgcttcacagccaacggtgcagattacaggggaacacagagctggacagcgctgcaaggtgggaagccatgtctgttctggaacgagactttccagcatccgtacaacacgctgaagtaccccaacggggaaggaggactgggcgagcacaattattgcagaaatccagatggagacgtgagcccttggtgctacgtggccgagcatgaggacggagtctactggaagtactgtgaaattcctgcctgccagatgcctggaaaccttggctgctacaaggatcatggaaacccacctcctctcacgggcaccagtaaaacctctaacaagctcaccatacaaacctgtatcagcttctgtcggagtcagagattcaagtttgctgggatggagtcaggctatgcctgcttctgtgggaacaatcctgactactggaagcacggggaggcggccagcaccgagtgcaatagtgtctgcttcggggaccacacgcagccctgcggtggggacggcaggattatcctctttgacactctcgtgggcgcctgcggtgggaactactcagccatggcagccgtggtgtactcccctgacttccctgacacctacgccactggcagagtctgctactggaccatccgggttccaggagcctctcgcatccatttcaacttcaccctgtttgatatcagggactctgcagacatggtggagctgctggacggctacacccaccgcgtcctggtccggctcagtgggaggagccgcccgcctctgtctttcaatgtctctctggattttgtcattttgtatttcttctctgatcgcatcaatcaggcccagggatttgctgtgttgtaccaagccaccaaggaggaaccgccacaggagagacctgctgtcaaccagaccctggcagaggtgatcaccgagcaagccaacctcagtgtcagcgctgcccactcctccaaagtcctctatgtcatcacccccagccccagccaccctccgcagactgcccaggtagccattcctgggcaccgtcagttggggccaacagccacagagtggaaggatggactgtgtacggcctggcgaccctcctcatcctcacagtcacagcagttgtcgcaaagattcttctgcatgtcacatttaaatctcatcgagtccctgcatcaggagaccttagggactgtcgtcagcctggggcttctggagatatctggaccattttctatgaaccttccactacaatctccatctttaagaagaagctcaagggtcagagtcaacaagatgaccgcaatcccctcg

SEQ ID NO: 439 - protein, 470 aa, Mus sp.
MAPPAARLALLSAAALTLAARPAPGPRSGPECFTANGADYRGTQSWTALQGGKPCLFWNETFQHPYNTLKYPNGEGGLGEHNYCRNPDGDVSPWCYVAEHEDGVYWKYCEIPACQMPGNLGCYKDHGNPPPLTGTSKTSNKLTIQTCISFCRSQRFKFAGMESGYACFCGNNPDYWKHGEAASTECNSVCFGDHTQPCGGDGRIILFDTLVGACGGNYSAMAAVVYSPDFPDTYATGRVCYWTIRVPGASRIHFNFTLFDIRDSADMVELLDGYTHRVLVRLSGRSRPPLSFNVSLDFVILYFFSDRINQAQGFAVLYQATKEEPPQERPAVNQTLAEVITEQANLSVSAAHSSKVLYVITPSPSHPPQTAQVAIPGHRQLGPTATEWKDGLCTAWRPSSSSQSQQLSQRFFCMSHLNLIESLHQETLGTVVSLGLLEISGPFSMNLPLQSPSLRRSSRVRVNKMTAIPS

SEQ ID NO: 440 - protein, 760 aa, Mus sp.
MALPSLGQDSWSLLRVFFFQLFLLPSLPPASGTGGQGPMPRVKYHAGDGHRALSFFQQKGLRDFDTLLLSDDGNTLYVGARETVLALNIQNPGIPRLKNMIPWPASERKKTECAFKKKSNETQCFNFIRVLVSYNATHLYACGTFAFSPACTFIELQDSLLLPILIDKVMDGKGQSPLTLFTSTQAVLVDGMLYSGTMNNFLGSEPILMRTLGSHPVLKTDIFLRWLHADASFVAAIPSTQVVYFFFEETASEFDFFEELYISRVAQVCKNDVGGEKLLQKKWTTFLKAQLLCAQPGQLPFNIIRHAVLLPADSPSVSRIYAVFTSQWQVGGTRSSAVCAFSLTDIERVFKGKYKELNKETSRWTTYRGSEVSPRPGSCSMGPSSDKALTFMKDHFLMDEHVVGTPLLVKSGVEYTRLAVESARGLDGSSHVVMYLGTSTGPLHKAVVPQDSSAYLVEEIQLSPDSEPVRNLQLAPAQGAVFAGFSGGIWRVPRANCSVYESCVDCVLARDPHCAWDPESRLCSLLSGSTKPWKQDMERGNPEWVCTRGPMARSPRRQSPPQLIKEVLTVPNSILELRCPHLSALASYHWSHGRAKISEASATVYNGSLLLLPQDGVGGLYQCVATENGYSYPVVSYWVDSQDQPLALDPELAGVPRERVQVPLTRVGGGASMAAQRSYWPHFLIVTVLLAIVLLGVLTLLLASPLGALRARGKVQGCGMLPPREKAPLSRDQHLQPSKDHRTSASDVDADNNHLGAEVA

SEQ ID NO: 441 - protein, 3046 aa, Mus sp.
CTCGGACGCCTGGGTTAGGGGTCTGTACTGCTGGGGAACCATCTGGTGACCATCTCAGGCTGACCATGGCCCTACCATCCCTGGGCCAGGACTCATGGAGTCTCCTGCGTGTTTTTTTCTTCCAACTCTTCCTGCTGCCATCACTGCCACCTGCTTCTGGGACTGGTGGTCAGGGGCCCATGCCCAGAGTCAAATACCATGCTGGAGACGGGCACAGGGCCCTCAGCTTCTTCCAACAAAAAGGCCTCCGAGACTTTGACACGCTGCTCCTGAGTGACGATGGCAACACTCTCTATGTGGGGGCTCGAGAGACCGTCCTGGCCTTGAATATCCAGAACCCAGGAATCCCAAGGCTAAAGAACATGATACCCTGGCCAGCCAGTGAGAGAAAAAAGACCGAATGTGCCTTTAAGAAGAAGAGCAATGAGACACAGTGTTTCAACTTCATTCGAGTCCTGGTCTCTTACAATGCTACTCACCTCTATGCCTGTGGGACCTTTGCCTTCAGCCCTGCCTGTACCTTCATTGAACTCCAAGATTCCCTCCTGTTGCCCATCTTGATAGACAAGGTCATGGACGGGAAGGGCCAAAGCCCTTTGACCCTGTTCACAAGCACACAAGCTGTCTTGGTCGATGGGATGCTTTATTCCGGCACCATGAACAACTTCCTGGGCAGCGAGCCCATCCTGATGCGGACACTGGGATCCCATCCTGTTCTCAAGACTGACATCTTCTTACGCTGGCTGCACGCGGATGCCTCCTTCGTGGCAGCCATTCCATCCACCCAGGTCGTCTATTTCTTCTTTGAGGAGACAGCCAGCGAGTTTGACTTCTTTGAAGAGCTGTATATATCCAGGGTGGCTCAAGTCTGCAAGAACGACGTGGGCGGTGAAAAGCTGCTGCAGAAGAAGTGGACCACCTTCCTCAAAGCCCAGTTGCTCTGCGCTCAGCCAGGGCAGCTGCCATTCAACATCATCCGCCACGCGGTCCTGCTGCCCGCCGATTCTCCCTCTGTTTCCCGCATCTACGCAGTCTTTACCTCCCAGTGGCAGGTTGGCGGGACCAGGAGCTCAGCAGTCTGTGCCTTCTCTCTCACGGACATTGAGCGAGTCTTTAAAGGGAAGTACAAGGAGCTGAACAAGGAGACCTCCCGCTGGACCACTTACCGGGGCTCAGAGGTCAGCCCGAGGCCAGGCAGTTGCTCCATGGGCCCCTCCTCTGACAAAGCCTTGACCTTCATGAAGGACCATTTTCTGATGGATGAGCACGTGGTAGGAACACCCCTGCTGGTGAAGTCTGGTGTGGAGTACACACGGCTTGCTGTGGAGTCAGCTCGGGGCCTTGATGGGAGCAGCCATGTGGTCATGTATCTGGGTACCTCCACGGGTCCCCTGCACAAGGCTGTGGTGCCTCAGGACAGCAGTGCTTATCTCGTGGAGGAGATTCAGCTGAGCCCTGACTCTGAGCCTGTTCGAAACCTGCAGCTGGCCCCCGCCCAGGGTGCAGTGTTTGCAGGCTTCTCTGGAGGCATCTGGAGAGTTCCCAGGGCCAATTGCAGTGTCTACGAGAGCTGTGTGGACTGTGTGCTTGCCAGGGACCCTCACTGTGCCTGGGACCCTGAATCAAGACTCTGCAGCCTTCTGTCTGGCTCTACCAAGCCTTGGAAGCAGGACATGGAACGCGGCAACCCGGAGTGGGTATGCACCCGTGGCCCCATGGCCAGGAGCCCCCGGCGTCAGAGCCCCCCTCAACTAATTAAAGAAGTCCTGACAGTCCCCAACTCCATCCTGGAGCTGCGCTGCCCCCACCTGTCAGCACTGGCCTCTTACCACTGGAGTCATGGCCGAGCCAAAATCTCAGAAGCCTCTGCTACCGTCTACAATGGCTCCCTCTTGCTGCTGCCGCAGGATGGTGTCGGGGGCCTCTACCAGTGTGTGGCGACTGAGAACGGCTACTCATACCCTGTGGTCTCCTATTGGGTAGACAGCCAGGACCAGCCCCTGGCGCTGGACCCTGAGCTGGCGGGCGTTCCCCGTGAGCGTGTGCAGGTCCCGCTGACCAGGGTCGGAGGCGGAGCTTCCATGGCTGCCCAGCGGTCCTACTGGCCCCATTTTCTCATCGTTACCGTCCTCCTGGCCATCGTGCTCCTGGGAGTGCTCACTCTCCTCCTCGCTTCCCCACTGGGGGCGCTGCGGGCTCGGGGTAAGGTTCAGGGCTGTGGGATGCTGCCCCCCAGGGAAAAGGCTCCACTGAGCAGGGACCAGCACCTCCAGCCCTCCAAGGACCACAGGACCTCTGCCAGTGACGTAGATGCCGACAACAACCATCTGGGCGCCGAAGTGGCTTAAACAGGGACACAGATCCGCAGCTGAGCAGAGCAAGCCACTGGCCTTGTTGGCTATGCCAGGCACAGTGCCACTCTGACCAGGGTAGGAGGCTCTCCTGCTAACGTGTGTCACCTACAGCACCCAGTAGGTCCTCCCCTGTGGGACTCTCTTCTGCAAGCACATTGGGCTGTCTCCATACCTGTACTTGTGCTGTGACAGGAAGAGCCAGACAGGTTTCTTTGATTTTGATTGACCCAAGAGCCCTGCCTGTAACAAACGTGCTCCAGGAGACCATGAAAGGTGTGGCTGTCTGGGATTCTGTGGTGACAAACCTAAGCATCCGAGCAAGCTGGGGCTATTCCTGCAAACTCCATCCTGAACGCTGTCACTCTAGAAGCAGCTGCTGCTTTGAACACCAGCCCACCCTCCTTCCCAAGAGTCTCTATGGAGTTGGCCCCTTGTGTTTCCTTTACCAGTCGGGCCATACTGTTTGGGAAGTCATCTCTGAAGTCTAACCACCTTCCTTCTTGGTTCAGTTTGGACAGATTGTTATTATTGTCTCTGCCCTGGCTAGAATGGGGGCATAATCTGAGCCTTGTTCCCTTGTCCAGTGTGGCTGACCCTTGACCTCTTCCTTCCTCCTCCCTTTGTTTTGGGATTCAGAAAACTGCTTGTCACAGACAATTTATTTTTTATTAAAAAAGATATAAGCTTTAAAG

SEQ ID NO: 442 - skipped
  Unknown

SEQ ID NO: 443 - skipped
  Unknown

SEQ ID NO: 444 - skipped
  Unknown

SEQ ID NO: 445 - protein, 398 aa, Homo sapiens
MWLLLTMASLISVLGTTHGLFGKLHPGSPEVTMNISQMITYWGYPNEEYEVVTEDGYILEVNRIPYGKKNSGNTGQRPVVFLQHGLLASATNWISNLPNNSLAFILADAGYDVWLGNSRGNTWARRNLYYSPDSVEFWAFSFDEMAKYDLPATIDFIVKKTGQKQLHYVGHSQGTTIGFIAFSTNPSLAKRIKTFYALAPVATVKYTKSLINKLRFVPQSLFKFIFGDKIFYPHNFFDQFLATEVCSREMLNLLCSNALFIICGFDSKNFNTSRLDVYLSHNPAGTSVQNMFHWTQAVKSGKFQAYDWGSPVQNRMHYDQSQPPYYNVTAMNVPIAVWNGGKDLLADPQDVGLLLPKLPNLIYHKEIPFYNHLDFIWAMDAPQEVYNDIVSMISEDKK

SEQ ID NO: 446 - protein, 760 aa, Mus sp.; identical to SEQ ID NO: 440

SEQ ID NO: 447 - DNA, 3046 bp, Mus sp.
ctcggacgcctgggttaggggtctgtactgctggggaaccatctggtgaccatctcaggctgaccatggccctaccatccctgggccaggactcatggagtctcctgcgtgtttttttcttccaactcttcctgctgccatcactgccacctgcttctgggactggtggtcaggggcccatgcccagagtcaaataccatgctggagacgggcacagggccctcagcttcttccaacaaaaaggcctccgagactttgacacgctgctcctgagtgacgatggcaacactctctatgtgggggctcgagagaccgtcctggccttgaatatccagaacccaggaatcccaaggctaaagaacatgataccctggccagccagtgagagaaaaaagaccgaatgtgcctttaagaagaagagcaatgagacacagtgtttcaacttcattcgagtcctggtctcttacaatgctactcacctctatgcctgtgggacctttgccttcagccctgcctgtaccttcattgaactccaagattccctcctgttgcccatcttgatagacaaggtcatggacgggaagggccaaagccctttgaccctgttcacaagcacacaagctgtcttggtcgatgggatgctttattccggcaccatgaacaacttcctgggcagcgagcccatcctgatgcggacactgggatcccatcctgttctcaagactgacatcttcttacgctggctgcacgcggatgcctccttcgtggcagccattccatccacccaggtcgtctatttcttctttgaggagacagccagcgagtttgacttctttgaagagctgtatatatccagggtggctcaagtctgcaagaacgacgtgggcggtgaaaagctgctgcagaagaagtggaccaccttcctcaaagcccagttgctctgcgctcagccagggcagctgccattcaacatcatccgccacgcggtcctgctgcccgccgattctccctctgtttcccgcatctacgcagtctttacctcccagtggcaggttggcgggaccaggagctcagcagtctgtgccttctctctcacggacattgagcgagtctttaaagggaagtacaaggagctgaacaaggagacctcccgctggaccacttaccggggctcagaggtcagcccgaggccaggcagttgctccatgggcccctcctctgacaaagccttgaccttcatgaaggaccattttctgatggatgagcacgtggtaggaacacccctgctggtgaagtctggtgtggagtacacacggcttgctgtggagtcagctcggggccttgatgggagcagccatgtggtcatgtatctgggtacctccacgggtcccctgcacaaggctgtggtgcctcaggacagcagtgcttatctcgtggaggagattcagctgagccctgactctgagcctgttcgaaacctgcagctggcccccgcccagggtgcagtgtttgcaggcttctctggaggcatctggagagttcccagggccaattgcagtgtctacgagagctgtgtggactgtgtgcttgccagggaccctcactgtgcctgggaccctgaatcaagactctgcagccttctgtctggctctaccaagccttggaagcaggacatggaacgcggcaacccggagtgggtatgcacccgtggccccatggccaggagcccccggcgtcagagcccccctcaactaattaaagaagtcctgacagtccccaactccatcctggagctgcgctgcccccacctgtcagcactggcctcttaccactggagtcatggccgagccaaaatctcagaagcctctgctaccgtctacaatggctccctcttgctgctgccgcaggatggtgtcgggggcctctaccagtgtgtggcgactgagaacggctactcataccctgtggtctcctattgggtagacagccaggaccagcccctggcgctggaccctgagctggcgggcgttccccgtgagcgtgtgcaggtcccgctgaccagggtcggaggcggagcttccatggctgcccagcggtcctactggccccattttctcatcgttaccgtcctcctggccatcgtgctcctgggagtgctcactctcctcctcgcttccccactgggggcgctgcgggctcggggtaaggttcagggctgtgggatgctgccccccagggaaaaggctccactgagcagggaccagcacctccagccctccaaggaccacaggacctctgccagtgacgtagatgccgacaacaaccatctgggcgccgaagtggcttaaacagggacacagatccgcagctgagcagagcaagccactggccttgttggctatgccaggcacagtgccactctgaccagggtaggaggctctcctgctaacgtgtgtcacctacagcacccagtaggtcctcccctgtgggactctcttctgcaagcacattgggctgtctccatacctgtacttgtgctgtgacaggaagagccagacaggtttctttgattttgattgacccaagagccctgcctgtaacaaacgtgctccaggagaccatgaaaggtgtggctgtctgggattctgtggtgacaaacctaagcatccgagcaagctggggctattcctgcaaactccatcctgaacgctgtcactctagaagcagctgctgctttgaacaccagcccaccctccttcccaagagtctctatggagttggccccttgtgtttcctttaccagtcgggccatactgtttgggaagtcatctctgaagtctaaccaccttccttcttggttcagtttggacagattgttattattgtctctgccctggctagaatgggggcataatctgagccttgttcccttgtccagtgtggctgacccttgacctcttccttcctcctccctttgttttgggattcagaaaactgcttgtcacagacaatttattttttattaaaaaagatataagctttaaag

SEQ ID NO: 448 - protein, 1436 aa, Bovine
MALGRHLSLRGLCVLLLGTMVGGQALELRLKDGVHRCEGRVEVKHQGEWGTVDGYRWTLKDASVVCRQLGCGAAIGFPGGAYFGPGLGPIWLLYTSCEGTESTVSDCEHSNIKDYRNDGYNHGRDAGVVCSGFVRLAGGDGPCSGRVEVHSGEAWIPVSDGNFTLATAQIICAELGCGKAVSVLGHELFRESSAQVWAEEFRCEGEEPELWVCPRVPCPGGTCHHSGSAQVVCSAYSEVRLMTNGSSQCEGQVEMNISGQWRALCASHWSLANANVICRQLGCGVAISTPGGPHLVEEGDQILTARFHCSGAESFLWSCPVTALGGPDCSHGNTASVICSGNQIQVLPQCNDSVSQPTGSAASEDSAPYCSDSRQLRLVDGGGPCAGRVEILDQGSWGTICDDGWDLDDARVVCRQLGCGEALNATGSAHFGAGSGPIWLDNLNCTGKESHVWRCPSRGWGQHNCRHKQDAGVICSEFLALRMVSEDQQCAGWLEVFYNGTWGSVCRNPMEDITVSTICRQLGCGDSGTLNSSVALREGFRPQWVDRIQCRKTDTSLWQCPSDPWNYNSCSPKEEAYIWCADSRQIRLVDGGGRCSGRVEILDQGSWGTICDDRWDLDDARVVCKQLGCGEALDATVSSFFGTGSGPIWLDEVNCRGEESQVWRCPSWGWRQHNCNHQEDAGVICSGFVRLAGGDGPCSGRVEVHSGEAWTPVSDGNFTLPTAQVICAELGCGKAVSVLGHMPFRESDGQVWAEEFRCDGGEPELWSCPRVPCPGGTCLHSGAAQVVCSVYTEVQLMKNGTSQCEGQVEMKISGRWRALCASHWSLANANVVCRQLGCGVAISTPRGPHLVEGGDQISTAQFHCSGAESFLWSCPVTALGGPDCSHGNTASVICSGNHTQVLPQCNDFLSQPAGSAASEESSPYCSDSRQLRLVDGGGPCGGRVEILDQGSWGTICDDDWDLDDARVVCRQLGCGEALNATGSAHFGAGSGPIWLDDLNCTGKESHVWRCPSRGWGRHDCRHKEDAGVICSEFLALRMVSEDQQCAGWLEVFYNGTWGSVCRSPMEDITVSVICRQLGCGDSGSLNTSVGLREGSRPRWVDLIQCRKMDTSLWQCPSGPWKYSSCSPKEEAYISCEGRRPKSCPTAAACTDREKLRLRGGDSECSGRVEVWHNGSWGTVCDDSWSLAEAEVVCQQLGCGQALEAVRSAAFGPGNGSIWLDEVQCGGRESSLWDCVAEPWGQSDCKHEEDAGVRCSGVRTTLPTTTAGTRTTSNSLPGIFSLPGVLCLILGSLLFLVLVILVTQLLRWRAERRALSSYEDALAEAVYEELDYLLTQKEGLGSPDQMTDVPDENYDDAEEVPVPGTPSPSQGNEEEVPPEKEDGVRSSQTGSFLNFSREAANPGEGEESFWLLQGKKGDAGYDDVELSALGTSPVTFS

SEQ ID NO: 449 - DNA, 4308 bp, Bovine
atggctctgggcagacacctctccctgcggggactctgtgtcctcctcctcggcaccatggtgggtggtcaagctctggagctgaggttgaaggatggagtccatcgctgtgaggggagagtggaagtgaagcaccaaggagaatggggcacagtggatggttacaggtggacattgaaggatgcatctgtagtgtgcagacagctggggtgtggagctgccattggttttcctggaggggcttattttgggccaggacttggccccatttggcttttgtatacttcatgtgaagggacagagtcaactgtcagtgactgtgagcattctaatattaaagactatcgtaatgatggctataatcatggtcgggatgctggagtagtctgctcaggatttgtgcgtctggctggaggggatggaccctgctcagggcgagtagaagtgcattctggagaagcttggatcccagtgtctgatgggaacttcacacttgccactgcccagatcatctgtgcagagttgggttgtggcaaggctgtgtctgtcctgggacatgagctcttcagagagtccagtgcccaggtctgggctgaagagttcaggtgtgagggggaggagcctgagctctgggtctgccccagagtgccctgtccagggggcacgtgtcaccacagtggatctgctcaggttgtttgttcagcatactcagaagtccggctcatgacaaacggctcctctcagtgtgaagggcaggtggagatgaacatttctggacaatggagagcgctctgtgcctcccactggagtctggccaatgccaatgttatctgtcgtcagctcggctgtggagttgccatctccacccccggaggaccacacttggtggaagaaggtgatcagatcctaacagcccgatttcactgctctggggctgagtccttcctgtggagttgtcctgtgactgccctgggtggtcctgactgttcccatggcaacacagcctctgtgatctgctcaggaaaccagatccaggtgcttccccagtgcaacgactccgtgtctcaacctacaggctctgcggcctcagaggacagcgccccctactgctcagacagcaggcagctccgcctggtggacgggggcggtccctgcgccgggagagtggagatccttgaccagggctcctggggcaccatctgtgatgacggctgggacctggacgatgcccgcgtggtgtgcaggcagctgggctgtggagaagccctcaatgccacggggtctgctcacttcggggcaggatcagggcccatctggttggacaacttgaactgcacaggaaaggagtcccacgtgtggaggtgcccttcccggggctgggggcagcacaactgcagacacaagcaggacgcgggggtcatctgctcagagttcctggccctcaggatggtgagtgaggaccagcagtgtgctgggtggctggaagttttctacaatgggacctggggcagtgtctgccgtaaccccatggaagacatcactgtgtccacgatctgcagacagcttggctgtggggacagtggaaccctcaactcttctgttgctcttagagaaggttttaggccacagtgggtggatagaatccagtgtcggaaaactgacacctctctctggcagtgtccttctgacccttggaattacaactcatgctctccaaaggaggaagcctatatctggtgtgcagacagcagacagatccgcctggtggatggaggtggtcgctgctctgggagagtggagatccttgaccagggctcctggggcaccatctgtgatgaccgctgggacctggacgatgcccgtgtggtgtgcaagcagctgggctgtggagaagccctggacgccactgtctcttccttcttcgggacgggatcagggcccatctggctggatgaagtgaactgcagaggagaggagtcccaagtatggaggtgcccttcctggggatggcggcaacacaactgcaatcatcaagaagatgcaggagtcatctgctcaggatttgtgcgtctggctggaggagatggaccctgctcagggcgagtagaagtgcattctggagaagcctggaccccagtgtctgatggaaacttcacactccccactgcccaggtcatctgtgcagagctgggatgtggcaaggctgtgtctgtcctgggacacatgccattcagagagtccgatggccaggtctgggctgaagagttcaggtgtgatgggggggagcctgagctctggtcctgccccagagtgccctgtccaggaggcacatgtctccacagtggagctgctcaggttgtctgttcagtgtacacagaagtccagcttatgaaaaacggcacctctcaatgtgaggggcaggtggagatgaagatctctggacgatggagagcgctctgtgcctcccactggagtctggccaatgccaatgttgtctgtcgtcagctcggctgtggagtcgccatctccacccccagaggaccacacttggtggaaggaggtgatcagatctcaacagcccaatttcactgctcaggggctgagtccttcctgtggagttgtcctgtgactgccttgggtgggcctgactgttcccatggcaacacagcctctgtgatctgctcaggaaaccacacccaggtgctgccccagtgcaacgacttcctgtctcaacctgcaggctctgcggcctcagaggagagttctccctactgctcagacagcaggcagctccgcctggtggacgggggcggtccctgcggcgggagagtggagatccttgaccagggctcctggggcaccatctgtgatgatgactgggacctggacgatgcccgtgtggtgtgcaggcagctgggctgtggagaagccctcaatgccacggggtctgctcacttcggggcaggatcagggcccatctggctggacgacctgaactgcacaggaaaggagtcccacgtgtggaggtgcccttcccggggctgggggcggcacgactgcagacacaaggaggacgccggggtcatctgctcagagttcctggccctcaggatggtgagcgaggaccagcagtgtgctgggtggctggaggttttctacaacgggacctggggcagtgtctgccgcagccccatggaagatatcactgtgtccgtgatctgcagacagcttggatgtggggacagtggaagtctcaacacctctgttggtctcagggaaggttctagaccccggtgggtagatttaattcagtgtcggaaaatggatacctctctctggcagtgtccttctggcccatggaaatacagttcatgctctccaaaggaggaagcctacatctcatgtgaaggaagaagacccaagagctgtccaactgctgccgcctgcacagacagagagaagctccgcctcaggggaggagacagcgagtgctcagggcgggtggaggtgtggcacaacggctcctggggcaccgtgtgcgatgactcctggagcctggcagaggctgaggtggtgtgtcagcagctgggctgtggccaggccctggaagccgtgcggtctgcagcatttggccctggaaatgggagcatctggctggacgaggtgcagtgcgggggccgggagtcctccctgtgggactgtgttgcggagccctgggggcagagcgactgcaagcacgaggaggatgctggtgtgaggtgctctggtgtaaggacaacattgcccacgaccacagcagggaccagaacaacctcaaattctctccctggcatcttctccctgcctggggttctctgccttatcctggggtcgcttctcttcctggtcctcgtcatcctggtgactcagctactcagatggagagcagagcgcagagccttatccagctatgaagatgctcttgctgaagctgtgtatgaggagctcgattaccttctgacacagaaggaaggtctgggcagcccagatcagatgactgatgtccctgatgaaaattatgatgatgctgaagaagtaccagtgcctggaactccttctccctctcaggggaatgaggaggaagtgcccccagagaaggaggacggggtgaggtcctctcagacaggctctttcctgaacttctccagagaggcagctaatcctggggaaggagaagagagcttctggctgctccaggggaagaaaggggatgctgggtatgatgatgttgaactcagtgccctgggaacatccccagtgactttctcg

SEQ ID NO: 450 - protein, 12 aa, Artificial Sequence
  Domain consensus sequence
  VARIANT (1)...(1): Xaa at position 1 can be L, I or V
  VARIANT (2)...(2): Xaa at position 2 can be any amino acid
  VARIANT (3)...(3): Xaa at position 3 can be L, I or V
  VARIANT (4)...(5): Xaa at positions 4 and 5 can be any amino acid. One or both of of residues 4 and 5 can be present.
  VARIANT (7)...(7): Xaa at position 7 can be any amino acid
  VARIANT (10)...(10): Xaa at position 10 can be N or H
  VARIANT (11)...(11): Xaa at position 11 can be any amino acid
XXXXXDXNDXXP

SEQ ID NO: 451 - protein, 16 aa, Artificial Sequence
  Domain consensus sequence
  VARIANT (1)...(1): Xaa at position 1 can be L, I, A or T
  VARIANT (2)...(4): Xaa at positions 2, 3 and 4 can be any amino acid
  VARIANT (6)...(7): Xaa at positions 6 and 7 can be any amino acid. One or both of of residues 6 and 7 can be present.
  VARIANT (8)...(8): Xaa at position 8 can be P or E
  VARIANT (9)...(10): Xaa at positions 9 and 10 can be any amino acid
  VARIANT (11)...(11): Xaa at position 11 can be L, I, V, M, F or Y
  VARIANT (12)...(12): Xaa at position 12 can be D, E, N, Q or S
  VARIANT (13)...(13): Xaa at position 13 can be S, T or A
  VARIANT (14)...(14): Xaa at position 14 can be A or V
  VARIANT (15)...(15): Xaa at position 15 can be L, I, V, M, F or Y
XXXXWXXXXXXXXXXX

SEQ ID NO: 452 - protein, 10 aa, Artificial Sequence
  Domain consensus sequence
  VARIANT (1)...(1): Xaa at position 1 can be G, S, T, A, L, I, V, or N
  VARIANT (2)...(3): Xaa at positions 2 and 3 can be any amino acid
  VARIANT (6)...(6): Xaa at position 6 can be L, I, V, M, F, Y, or W
  VARIANT (7)...(7): Xaa at position 7 can be D, E, G, H, R, K, or P
  VARIANT (9)...(9): Xaa at position 9 can be any amino acid
  VARIANT (10)...(10): Xaa at position 10 can be L, I, V, M, F, Y, W, G, S, P, or Q
XXXHEXXHXX

SEQ ID NO: 453 - protein, 8 aa, Artificial Sequence
  Domain consensus sequence
  VARIANT (4)...(4): Xaa at position 4 can be G or N
  VARIANT (5)...(5): Xaa at position 5 can be any amino acid
  VARIANT (7)...(7): Xaa at position 7 can be D or R
  VARIANT (8)...(8): Xaa at position 8 can be L, I, V, S, A, P, K, or Q
  VARIANT (1)...(8): Xaa = Any Amino Acid
PRCXXPXX

SEQ ID NO: 454 - protein, 38 aa, Artificial Sequence
  Domain consensus sequence
  VARIANT (1)...(12): Xaa at positions, 1, 2, 3, 4, 5, 6, 7, 8, 9, 10, 11 and 12 can be any amino acid
  VARIANT (14)...(16): Xaa at positions 14, 15 and 16 can be any amino acid
  VARIANT (18)...(18): Xaa at position 18 can be any amino acid
  VARIANT (20)...(25): Xaa at positions 20, 21, 22, 23, 24 and 25 can be any amino acid
  VARIANT (26)...(26): Xaa at position 26 can be D, E or N
  VARIANT (27)...(27): Xaa at position 27 can be any amino acid
  VARIANT (28)...(28): Xaa at position 28 can be L, I, V, M, F, or Y
  VARIANT (29)...(37): Xaa at positions 29, 30, 31, 32, 33, 34, 35, 36 and 37 can be any amino acid
  VARIANT (38)...(38): Xaa at position 38 can be F, Y or W
XXXXXXXXXXXXEXXXEXCXXXXXXXXXXXXXXXXXXX

SEQ ID NO: 455 - protein, 6 aa, Artificial Sequence
  Domain consensus sequence
  VARIANT (1)...(1): Xaa at position 1 can be F or Y
  VARIANT (6)...(6): Xaa at position 6 can be D, N or R
  VARIANT (1)...(6): Xaa = Any Amino Acid
XCRNPX

SEQ ID NO: 456 - protein, 38 aa, Artificial Sequence
  Domain consensus sequence
  VARIANT (2)...(6): Xaa at positions 2, 3, 4, 5 and 6 can be any amino acid
  VARIANT (8)...(9): Xaa at positions 8 and 9 can be any amino acid
  VARIANT (11)...(16): Xaa at positions 11, 12, 13, 14, 15 and 16 can be any amino acid
  VARIANT (19)...(20): Xaa at positions 19 and 20 can be any amino acid
  VARIANT (22)...(24): Xaa at positions 22, 23 and 24 can be any amino acid
  VARIANT (25)...(25): Xaa at position 25 can be F, Y or W
  VARIANT (26)...(33): Xaa at positions 26, 27, 28, 29, 30, 31, 32 and 33 can be any amino acid
  VARIANT (35)...(37): Xaa at positions 35, 36 and 37 can be any amino acid
GXXXXXGXXEXXXXXXWGXXCXXXXXXXXXXXXCXXXG

SEQ ID NO: 457 - protein, 26 aa, Artificial Sequence
  Domain consensus sequence
  VARIANT (1)...(3): Xaa at positions 1, 2 and 3 can be any amino acid
  VARIANT (5)...(5): Xaa at position 5 can be any amino acid
  VARIANT (6)...(6): Xaa at position 6, when present, can be any amino acid
  VARIANT (7)...(7): Xaa at position 7 can be E or Q
  VARIANT (8)...(11): Xaa at positions 8, 9, 10 and 11 can be any amino acid
  VARIANT (12)...(12): Xaa at position 12 can be L, I, V or M
  VARIANT (13)...(13): Xaa at position 13, when present, can be any amino acid
  VARIANT (14)...(14): Xaa at position 14 can be E, Q or K
  VARIANT (15)...(25): Xaa at positions 15, 16, 17, 18, 19, 20, 21, 22, 23, 24 and 25 can be any amino acid
XXXLXXXXXXXXXXXXXXXXXXXXXP

SEQ ID NO: 458 - protein, 22 aa, Artificial Sequence
  Leucine Zipper Region of TANGO 366
LDLSGTNLVPLPEALLLHLPAL

SEQ ID NO: 459 - protein, 22 aa, Artificial Sequence
  Leucine Zipper Region of INTERCEPT 217
LSCTGLGLQDVPAELPAATADL

SEQ ID NO: 460 - protein, 22 aa, Artificial Sequence
  Leucine Zipper Region of TANGO 331
LEAQEEHLEAWWLQLKSEYPDL

What is claimed is:

1. An isolated monoclonal antibody, or antigen binding fragment thereof, that specifically binds to a polypeptide selected from the group consisting of:
   a) a polypeptide comprising the amino acid sequence of SEQ ID NO:417;
   b) a polypeptide comprising the amino acid sequence of SEQ ID NO:419;
   c) the polypeptide encoded by the nucleic acid molecule of SEQ ID NO:415 or 416; and
   d) the polypeptide encoded by the nucleotide sequence of the DNA insert of clone EpT294, which was deposited with ATCC as Accession Number 207220.

2. The antibody, or antigen binding fragment thereof of claim 1, wherein said antibody is selected from the group consisting of:
   i) a humanized antibody;
   ii) a chimeric antibody; and
   iii) a human antibody.

3. The antibody, or antigen binding fragment thereof of claim 1, wherein said antigen binding fragment is a F(ab) fragment or a F(ab')$_2$ fragment.

4. The antibody, or antigen binding fragment thereof of claim 1, wherein said antibody binds to a polypeptide comprising amino acid residues 15-423 of SEQ ID NO:417.

5. The antibody, or antigen binding fragment thereof of claim 1, wherein said antibody binds to a polypeptide comprising amino acid residues 34 to 254 of SEQ ID NO:417.

6. The antibody, or antigen binding fragment thereof of claim 1, wherein said antibody is detectably labeled.

7. The antibody, or antigen binding fragment thereof of claim 6, wherein the detectable label is selected from the group consisting of:
   a) enzymes;
   b) prosthetic groups;
   c) fluorescent materials;
   d) luminescent materials;
   e) bioluminescent materials; and
   f) radioactive materials.

* * * * *